(12) United States Patent
Curtis et al.

(10) Patent No.: US 6,972,187 B2
(45) Date of Patent: Dec. 6, 2005

(54) OAT5 MOLECULES AND USES THEREFOR

(75) Inventors: Rory A. J. Curtis, Framingham, MA (US); Maria Alexandra Glucksmann, Lexington, MA (US); Rachel E. Meyers, Newton, MA (US)

(73) Assignee: Millennium Pharmaceuticals, Inc., Cambridge, MA (US)

( * ) Notice: Subject to any disclaimer, the term of this patent is extended or adjusted under 35 U.S.C. 154(b) by 60 days.

(21) Appl. No.: 10/154,419

(22) Filed: May 22, 2002

(65) Prior Publication Data

US 2003/0143675 A1 Jul. 31, 2003

Related U.S. Application Data

(63) Continuation-in-part of application No. 10/055,025, filed on Jan. 22, 2002, now abandoned, and a continuation-in-part of application No. 10/024,623, filed on Dec. 17, 2001, and a continuation-in-part of application No. 10/002,769, filed on Nov. 14, 2001, now abandoned, and a continuation-in-part of application No. 09/972,724, filed on Oct. 5, 2001, now abandoned, and a continuation-in-part of application No. 09/964,295, filed on Sep. 25, 2001, now abandoned, and a continuation-in-part of application No. 09/957,664, filed on Sep. 19, 2001, now abandoned, and a continuation-in-part of application No. 09/919,781, filed on Jul. 31, 2001, now abandoned, and a continuation-in-part of application No. 09/895,811, filed on Jun. 29, 2001, now abandoned, and a continuation-in-part of application No. 09/858,194, filed on May 14, 2001, now abandoned.

(60) Provisional application No. 60/324,016, filed on Sep. 20, 2001, provisional application No. 60/263,169, filed on Jan. 22, 2001, provisional application No. 60/258,028, filed on Dec. 21, 2000, provisional application No. 60/256,588, filed on Dec. 18, 2000, provisional application No. 60/256,240, filed on Dec. 15, 2000, provisional application No. 60/248,878, filed on Nov. 15, 2000, provisional application No. 60/248,364, filed on Nov. 15, 2000, provisional application No. 60/238,336, filed on Oct. 5, 2000, provisional application No. 60/235,107, filed on Sep. 25, 2000, provisional application No. 60/233,790, filed on Sep. 19, 2000, provisional application No. 60/221,769, filed on Jul. 31, 2000, provisional application No. 60/215,376, filed on Jun. 29, 2000, and provisional application No. 60/204,211, filed on May 12, 2000.

(51) Int. Cl.[7] .................. C12N 15/00; C12N 15/63; C12N 15/85; C12N 1/21; C07H 21/04
(52) U.S. Cl. ................ 435/69.1; 435/325; 435/252.3; 435/254.11; 435/254.2; 435/320.1; 536/23.5
(58) Field of Search ............... 536/23.5; 435/320.1, 435/325, 252.3, 254.11, 254.2, 69.1

(56) References Cited

U.S. PATENT DOCUMENTS 6,680,379 B1 * 1/2004 Sun ........................... 536/23.2

FOREIGN PATENT DOCUMENTS

WO   WO 98/45437 A2   10/1998

OTHER PUBLICATIONS

Sweet et al., The organic anion transporter family: from physiology to ontogeny and the clinic. Am. J. Physiol. Renal Physiol. 281: F197–F205, 2001.*
Fu–zhang, W., Cloning and characterization of two novel OATP genes on human 5q21.1. GenBank Database, Accession No. AY273896, Dec. 1, 2003.*
DGene Accession No. AAV87708; New polynucleotides encoding human secreted proteins—derived from e.g. human blood, kidney, foetal lung, placenta, testes, brain, ovary, pituitary, retina and colon cDNA libraries (Feb. 12, 1999).
EST database Accession No. AA619778; SW:PGT_RAT Q00910 Prostaglandin Transporter (Oct. 9, 1997).
MØller, J. V. et al. "Renal Organic Anion Transport System: Pharmacological, Physiological, and Biochemical Aspects" *Pharmacological Reviews* Dec., 1982 vol. 34, No. 4 pp. 315–358.
Petzinger, E. "Transport of Organic Anions in the Liver. An Update on Bile Acid, Fatty Acid, Monocarboxylate, Anionic Amino Acid, Cholephilic Organic Anion, and Anionic Drug Transport" *Review of Physiology, Biochemistry and Pharmacology* (1994) vol. 123, pp. 47–211.
Pritchard, J.B. et al. "Mechanisms Mediating Renal Secretion of Organic Anions and Cations" *Physiological Reviews* Oct. 1993, vol. 73, No. 4 pp. 765–796.
Ullrich, K.J. "Renal Transporters for Organic Anions and Organic Cations, Structural Requirements for Substrates" *The Journal of Membrane Biology* Jul. 15, 1997, vol. 158, pp. 95–107.
Ullrich K.J. et al. "Renal Transport Mechanisms for Xenobiotics: Chemicals and Drugs" *The Clinical Investigator* Oct. 1993, vol. 71, pp. 843–848.

* cited by examiner

*Primary Examiner*—Brenda Brumback
*Assistant Examiner*—Ruixiang Li
(74) *Attorney, Agent, or Firm*—Millennium Pharmaceuticals, Inc.

(57) ABSTRACT

The invention provides isolated nucleic acids molecules, designated OAT5 nucleic acid molecules, which encode organic anion transporters. The invention also provides antisense nucleic acid molecules, recombinant expression vectors containing OAT5 nucleic acid molecules, host cells into which the expression vectors have been introduced, and non-human transgenic animals in which a OAT5 gene has been introduced or disrupted. The invention still further provides isolated OAT5 polypeptides, fusion polypeptides, antigenic peptides and anti-OAT5 antibodies. Diagnostic and therapeutic methods utilizing compositions of the invention are also provided.

12 Claims, 12 Drawing Sheets

```
Input file Fbh57312FL.seq; Output File Fbh57312FL.tra
Sequence length 2206
AATTCCCGGGTCGACCCACGCGTCCGAGAACTCAGAAGGTGGCTCAGCCCTCTGGTCCACACTTGGTGGGCAGCTCGGA
TGCCCCAGGCAGCCCGGGCACAGTGAGCTTAGTCCCCTTCACCCCCTCCGCAGAGCTCTGGGGCATCCGCACAGTCACT
CCTGGACACAAGATAAGGAGGAGTTTCCCCGAGGCATCACAGGGCTTCCCGGGACTGAGGGACTGACTCAACTGGTTAT
TGGACAGTGCCCCACCCCCAATCCGGCTGAGGGGCAGGAAGGCAGAAGGTCTTGGTGGCCCTGGATCTTGTGGCTGCAA
                                                              M  A  F  S  K  L       6
TCGGTTCCAAACAGCAGTTAGGTCAGCAGTCCGCTCAGCCGAGGCAGCTCTGTTC ATG GCG TTC TCG AAG CTC  18

L   E   Q   A   G   G   V   G   L   F   Q   T   L   Q   V   L   T   F   I   L     26
TTG GAG CAA GCC GGA GGC GTG GGC CTC TTC CAG ACC CTG CAG GTG CTC ACC TTC ATC CTC    78

P   C   L   M   I   P   S   Q   M   L   L   E   N   F   S   A   A   I   P   G     46
CCC TGC CTC ATG ATA CCT TCC CAG ATG CTC CTG GAG AAC TTC TCA GCC GCC ATC CCA GGC   138

H   R   C   W   T   H   M   L   D   N   G   S   A   V   S   T   N   M   T   P     66
CAC CGA TGC TGG ACA CAC ATG CTG GAC AAT GGC TCT GCG GTT TCC ACA AAC ATG ACC CCC   198

K   A   L   L   T   I   S   I   P   P   G   P   N   Q   G   P   H   Q   C   R     86
AAG GCC CTT CTG ACC ATC TCC ATC CCG CCA GGC CCC AAC CAG GGG CCC CAC CAG TGC CGC   258

R   F   R   Q   P   Q   W   Q   L   L   D   P   N   A   T   A   T   S   W   S    106
CGC TTC CGC CAG CCA CAG TGG CAG CTC TTG GAC CCC AAT GCC ACG GCC ACC AGC TGG AGC   318

E   A   D   T   E   P   C   V   D   G   W   V   Y   D   R   S   V   F   T   S    126
GAA GCT GAC ACG GAG CCG TGT GTG GAC GGC TGG GTC TAT GAC CGC AGC GTC TTC ACC TCC   378

T   I   V   A   K   W   D   L   V   C   S   S   Q   G   L   K   P   L   S   Q    146
ACC ATC GTG GCC AAG TGG GAC CTG GTG TGC AGC TCC CAG GGC TTG AAG CCC CTA AGC CAG   438

S   I   F   M   S   G   I   L   V   G   S   F   I   W   G   L   L   S   Y   R    166
TCC ATC TTC ATG TCC GGG ATC CTG GTG GGC TCC TTT ATC TGG GGC CTC CTC TCC TAC CGG   498

F   G   R   K   P   M   L   S   W   C   C   L   Q   L   A   V   A   G   T   S    186
TTT GGG AGG AAG CCG ATG CTG AGC TGG TGC TGC CTG CAG TTG GCC GTG GCG GGC ACC AGC   558

T   I   F   A   P   T   F   V   I   T   C   G   L   R   F   V   A   A   F   G    206
ACC ATC TTC GCC CCA ACA TTC GTC ATC TAC TGC GGC CTG CGG TTC GTG GCC GCT TTT GGG   618

M   A   G   I   F   L   S   S   L   T   L   M   V   E   W   T   T   T   S   R    226
ATG GCC GGC ATC TTT CTG AGT TCA CTG ACA CTG ATG GTG GAG TGG ACC ACG ACC AGC AGG   678

R   A   V   T   M   T   V   V   G   C   A   F   S   A   G   Q   A   A   L   G    246
AGG GCG GTC ACC ATG ACG GTG GTG GGA TGT GCC TTC AGC GCA GGC CAG GCG GCG CTG GGC   738

G   L   A   F   A   L   R   D   W   R   T   L   Q   L   A   A   S   V   P   F    266
GGC CTG GCC TTT GCC CTG CGG GAC TGG AGG ACT CTC CAG CTG GCA GCA TCA GTG CCC TTC   798

F   A   I   S   L   I   S   W   W   L   P   E   S   A   R   W   L   I   I   K    286
TTT GCC ATC TCC CTG ATA TCC TGG TGG CTG CCA GAA TCC GCC CGG TGG CTG ATT ATT AAG   858

G   K   P   D   Q   A   L   Q   E   L   R   K   V   A   R   I   N   G   H   K    306
GGC AAA CCA GAC CAA GCA CTT CAG GAG CTC AGA AAG GTG GCC AGG ATA AAT GGC CAC AAG   918

E   A   K   N   L   T   I   E   V   L   M   S   S   V   K   E   E   V   A   S    326
GAG GCC AAG AAC CTG ACC ATA GAG GTG CTG ATG TCC AGC GTG AAG GAG GAG GTG GCC TCT   978

A   K   E   P   R   S   V   L   D   L   F   C   V   P   V   L   R   W   R   S    346
GCA AAG GAG CCG CGG TCG GTG CTG GAC CTG TTC TGC GTG CCC GTG CTC CGC TGG AGG AGC  1038
```

FIG. 1A

```
  C   A   M   L   V   V   N   F   S   L   L   I   S   Y   Y   G   L   V   F   D   366
TGC GCC ATG CTG GTG GTG AAT TTC TCT CTA TTG ATC TCC TAC TAT GGG CTG GTC TTC GAC 1098

L   Q   S   L   G   R   D   I   F   L   L   Q   A   L   F   G   A   V   D   F   386
CTG CAG AGC CTG GGC CGT GAC ATC TTC CTC CTC CAG GCC CTC TTC GGG GCC GTG GAC TTC 1158

L   G   R   A   T   T   A   L   L   S   F   L   G   R   R   T   I   Q   A   406
CTG GGC CGG GCC ACC ACT GCC CTC TTG CTC AGT TTC CTT GGC CGC CGC ACC ATC CAG GCG 1218

G   S   Q   A   M   A   G   L   A   I   L   A   N   M   L   V   P   Q   D   L   426
GGT TCC CAG GCC ATG GCC GGC CTC GCC ATT CTA GCC AAC ATG CTG GTG CCG CAA GAT TTG 1278

Q   T   L   R   V   V   F   A   V   L   G   K   G   C   F   G   I   S   L   T   446
CAG ACC CTG CGT GTG GTC TTT GCT GTG CTG GGA AAG GGA TGT TTT GGG ATA AGC CTA ACC 1338

C   L   T   I   Y   K   A   E   L   F   P   T   P   V   R   M   T   A   D   G   466
TGC CTC ACC ATC TAC AAG GCT GAA CTC TTT CCA ACG CCA GTG CGG ATG ACA GCA GAT GGC 1398

I   L   H   T   V   G   R   L   G   A   M   M   G   P   L   I   L   M   S   R   486
ATT CTG CAT ACA GTG GGC CGG CTG GGG GCT ATG ATG GGT CCC CTG ATC CTG ATG AGC CGC 1458

Q   A   L   P   L   L   P   P   L   L   Y   G   V   I   S   I   A   S   S   L   506
CAA GCC CTG CCC CTG CTG CCT CCT CTC CTC TAT GGC GTT ATC TCC ATT GCT TCC AGC CTG 1518

V   V   L   F   F   L   P   E   T   Q   G   L   P   L   P   D   T   I   Q   D   526
GTT GTG CTG TTC TTC CTC CCG GAG ACC CAG GGA CTT CCG CTC CCT GAC ACT ATC CAG GAC 1578

L   E   S   Q   K   S   T   A   A   Q   G   N   R   Q   E   A   V   T   V   E   546
CTG GAG AGC CAG AAA TCA ACA GCA GCC CAG GGC AAC CGG CAA GAG GCC GTC ACT GTG GAA 1638

S   T   S   L   *                                                                 551
AGT ACC TCG CTC TAG                                                                1653

AAATTGTGCCTGCATGGAGCCCCTTTAGTCAAAGACTCCTGGAAAGGAGTTGCCTCTTCTCAATCAGAGCGTGGAGGCG

AGTTGGGCGACTTCAAGGGCCTGGCATGGCAGAGCCAGCAGCCGTGGCGAGTGGACAGCGTGGCCGTCTGCTGTGGCTG

AAGCAGCTTCACAGTACTTCTCTT
```

FIG. 1B

```
Input file Fbh53659pat.seq; Output File Fbh53659pat.tra
Sequence length 2175

M   K   S   A   K   G   I   E   N   L   A   F   V   P   S   S   P   D   I   L    20
ATG AAG AGC GCC AAA GGT ATT GAG AAC TTG GCT TTT GTC CCC TCC AGC CCA GAC ATC CTG    60

R   R   L   S   A   S   P   S   Q   I   E   V   S   A   L   S   S   D   P   Q    40
CGC CGC TTG TCT GCG TCG CCC TCC CAA ATC GAA GTC TCT GCC TTG TCC TCT GAC CCC CAA   120

R   E   N   S   Q   P   Q   E   L   Q   K   P   Q   E   P   Q   K   S   P   E    60
AGA GAG AAT TCT CAG CCA CAG GAG CTT CAG AAG CCC CAG GAG CCC CAG AAG TCA CCA GAG   180

P   S   L   P   S   A   P   P   S   V   S   E   E   K   L   R   S   L   S   L    80
CCA TCT CTG CCT TCA GCC CCT CCC AGT GTC TCC GAA GAG AAG CTC CGG TCA CTG TCG CTG   240

S   E   F   E   E   G   S   Y   G   W   R   N   F   H   P   Q   C   L   Q   R   100
TCC GAG TTT GAG GAG GGG TCT TAC GGC TGG AGG AAC TTC CAT CCT CAA TGT CTC CAG CGC   300

C   N   T   P   G   G   F   L   L   H   Y   C   L   L   A   V   T   Q   G   I   120
TGC AAC ACA CCT GGA GGC TTT CTG CTT CAC TAC TGC CTC TTG GCC GTC ACG CAA GGT ATT   360

V   V   N   G   L   V   N   I   S   I   S   T   V   E   K   R   Y   E   M   K   140
GTA GTT AAT GGC CTA GTA AAT ATT AGC ATT TCC ACT GTT GAG AAG CGT TAT GAA ATG AAG   420

S   S   L   T   G   L   I   S   S   Y   D   I   S   F   C   L   L   S   L   160
AGT TCC CTG ACT GGC CTG ATT TCA TCA AGC TAC GAT ATT TCA TTC TGT TTG TTG TCT TTA   480

F   V   S   F   F   G   E   R   G   H   K   P   R   W   L   A   F   A   A   F   180
TTT GTA TCA TTC TTT GGT GAA AGA GGA CAT AAG CCG AGA TGG CTT GCA TTT GCA GCC TTT   540

M   I   G   L   G   A   L   V   F   S   L   P   Q   F   F   S   G   E   Y   K   200
ATG ATT GGA CTG GGA GCA CTT GTA TTC TCA TTG CCA CAA TTT TTC AGT GGA GAA TAT AAA   600

L   G   S   L   F   E   D   T   C   V   T   T   R   N   S   T   S   C   T   S   220
TTG GGG TCT CTT TTT GAA GAC ACT TGT GTA ACA ACA AGG AAT AGC ACC AGT TGT ACA TCT   660

S   T   S   S   L   S   N   Y   L   Y   V   F   I   L   G   Q   L   L   L   G   240
TCA ACT TCT TCA CTT TCT AAC TAC TTG TAT GTC TTC ATC TTG GGA CAA CTA TTG CTG GGG   720

A   G   G   T   P   L   Y   T   L   G   T   A   F   L   D   D   S   V   P   T   260
GCA GGA GGA ACT CCT CTT TAT ACT CTG GGA ACA GCC TTT CTT GAT GAT TCT GTG CCC ACA   780

H   K   S   S   L   Y   I   G   T   G   Y   V   M   S   I   L   G   P   A   I   280
CAC AAG TCT TCT CTC TAT ATA GGA ACC GGT TAT GTT ATG TCA ATC TTA GGC CCT GCT ATT   840

G   Y   V   L   G   G   Q   L   L   T   I   Y   I   D   V   A   M   G   E   S   300
GGC TAT GTA TTG GGA GGA CAA CTG CTA ACC ATA TAC ATT GAT GTT GCT ATG GGA GAA AGC   900

T   D   V   T   E   D   D   P   R   W   L   G   A   W   W   I   G   F   L   L   320
ACT GAT GTC ACT GAG GAT GAT CCG CGA TGG TTG GGA GCT TGG TGG ATT GGG TTT CTT CTA   960

S   W   I   F   A   W   S   L   I   I   P   F   S   C   F   P   K   H   L   P   340
TCA TGG ATC TTT GCT TGG TCT TTA ATA ATA CCT TTT TCT TGC TTT CCA AAA CAT TTA CCA  1020

G   T   A   E   I   Q   A   G   K   T   S   Q   A   H   Q   S   N   S   N   A   360
GGT ACA GCA GAA ATT CAA GCT GGA AAA ACT TCC CAG GCT CAT CAG AGT AAT AGT AAT GCA  1080
```

FIG. 2A

```
  D   V   K   F   G   K   S   I   K   D   F   P   A   A   L   K   N   L   M   K    380
GAT GTG AAA TTT GGA AAA AGT ATT AAA GAT TTT CCA GCT GCT CTA AAG AAT TTG ATG AAG   1140

N   A   V   F   M   C   L   V   L   S   T   S   S   E   A   L   I   T   T   G    400
AAT GCT GTC TTT ATG TGT TTA GTT CTA TCA ACT TCT TCA GAA GCC TTA ATT ACT ACT GGA   1200

F   A   T   F   L   P   K   F   I   E   N   Q   F   G   L   T   S   S   F   A    420
TTT GCT ACA TTT TTA CCT AAA TTT ATA GAA AAT CAA TTC GGA TTG ACA TCC AGC TTC GCA   1260

A   T   L   G   G   A   V   L   I   P   G   A   A   L   G   Q   I   L   G   G    440
GCT ACT CTT GGA GGG GCT GTT TTA ATT CCT GGA GCT GCT CTC GGT CAA ATT TTA GGT GGC   1320

F   L   V   S   K   F   R   M   T   C   K   N   T   M   K   F   A   L   F   T    460
TTC CTT GTT TCA AAA TTC AGA ATG ACA TGT AAA AAC ACA ATG AAG TTT GCA CTG TTC ACA   1380

S   G   V   A   L   T   L   S   F   V   F   M   Y   A   K   C   E   N   E   P    480
TCT GGA GTT GCA CTT ACG CTG AGT TTT GTA TTT ATG TAT GCC AAA TGT GAA AAT GAG CCA   1440

F   A   G   V   S   E   S   Y   N   G   T   G   E   L   G   N   L   I   A   P    500
TTT GCT GGT GTA TCT GAA TCA TAT AAT GGG ACT GGA GAA TTG GGA AAC TTG ATA GCC CCT   1500

C   N   A   N   C   N   C   S   R   S   Y   Y   Y   P   V   C   G   D   G   V    520
TGT AAT GCC AAT TGT AAC TGT TCG CGA TCA TAT TAT TAT CCT GTC TGT GGA GAT GGA GTC   1560

Q   Y   F   S   P   C   F   A   G   C   S   N   P   V   A   H   R   K   P   K    540
CAA TAT TTT TCT CCC TGC TTT GCA GGC TGT TCA AAC CCA GTT GCA CAC AGG AAG CCA AAG   1620

V   Y   Y   N   C   S   C   I   E   R   K   T   E   I   T   S   T   A   E   T    560
GTA TAT TAC AAC TGT TCC TGT ATT GAA AGG AAA ACA GAA ATA ACA TCC ACT GCA GAA ACT   1680

F   G   F   E   A   K   A   G   K   C   E   T   H   C   A   K   L   P   I   F    580
TTT GGT TTT GAA GCT AAA GCT GGA AAA TGT GAA ACT CAT TGT GCG AAA CTG CCC ATA TTC   1740

L   C   I   F   F   I   V   I   I   F   T   F   M   A   G   T   P   I   T   V    600
CTT TGC ATT TTC TTT ATT GTA ATT ATT TTT ACC TTT ATG GCC GGT ACT CCT ATA ACT GTG   1800

S   I   L   R   C   V   N   H   R   Q   R   S   L   A   L   G   I   Q   F   M    620
TCT ATC CTA AGG TGT GTT AAT CAC AGA CAA CGG TCC CTA GCC TTG GGA ATA CAA TTT ATG   1860

V   L   R   L   L   G   T   I   P   G   P   I   I   F   G   F   T   I   D   S    640
GTC CTT CGA TTA TTA GGG ACA ATT CCT GGA CCA ATT ATA TTT GGT TTC ACA ATA GAC AGC   1920

T   C   I   L   W   D   I   N   D   C   G   I   K   G   A   C   W   I   Y   D    660
ACA TGT ATT CTT TGG GAT ATA AAT GAT TGT GGA ATT AAA GGA GCT TGC TGG ATT TAT GAT   1980

N   I   K   M   A   H   M   L   V   A   I   S   V   T   C   K   V   I   T   M    680
AAC ATC AAG ATG GCC CAT ATG CTA GTA GCC ATA AGT GTT ACT TGT AAA GTT ATC ACC ATG   2040

F   F   N   G   F   A   I   F   L   Y   K   P   P   P   S   A   T   D   V   S    700
TTC TTC AAT GGA TTT GCA ATC TTT TTG TAT AAA CCA CCT CCA TCA GCC ACA GAT GTG TCA   2100

F   H   K   E   N   A   V   V   T   N   V   L   A   E   Q   D   L   N   K   I    720
TTT CAT AAA GAG AAT GCA GTT GTG ACT AAT GTT TTA GCA GAA CAG GAT CTC AAC AAA ATA   2160

V   K   E   G   *                                                                  725
GTA AAA GAA GGG TGA                                                                 2175
```

FIG. 2B

Protein Family / Domain Matches, HMMer version 2
Searching for complete domains in PFAM
hmmpfam - search a single seq against HMM database
HMMER 2.1.1
Copyright (C)          Washington University School of Medicine
HMMER is freely distributed under the GNU General Public License (GPL).
- - - - - - - - - - - - - - - - - - - - - - - - - - - - - - - - - - - - -
HMM file:              /prod/ddm/seqanal/PFAM/pfam5.3/Pfam
Sequence file:         /prod/ddm/wspace/orfanal/oa-script.1481.seq
- - - - - - - - - - - - - - - - - - - - - - - - - - - - - - - - - - - - -
Query:    Fbh57312

Scores for sequence family classification (score includes all domains):
Model      Description                                    Score    E-value   N
---------  -----------                                    -----    -------  ---
sugar_tr   Sugar (and other) transporter                   34.7    4.8e-08   1

Parsed for domains:
Model      Domain   seq-f  seq-t    hmm-f  hmm-t       score   E-value
---------  ------   -----  -----    -----  -----       -----   -------
sugar_tr   1/1       103    527 ..     1    487 []      34.7   4.8e-08

Alignments of top-scoring domains:
sugar_tr: domain 1 of 1, from 103 to 527: score 34.7, E = 4.8e-08
             *->valvaalgGgflfGyDtgviggflalidflfrfglltssgalaelgy
                ++  a +  ++ G+       +++++ +++    +++    ++
Fbh57312 103    TSWSEADTEPCVDGWVYDRSVFTSTIVAKWDLVCSSQGLKP------ 143 stvltglvvsifflGrliGslfaGklgdrfGRkkslllalvlfviGalls
                1+ sif+  G l+Gs+++G l+ rfGRk++l  ++++   ++++   +
Fbh57312 144 ------LSQSIFMSGILVGSFIWGLLSYRFGRKPMLSWCCLQLAVAGTST 187 gaapgytTiGlwafyllivGRvlvGlgvGgasvlvPmYisEiAPkalRGa
             ++ap          +f   ++  R+++  +g+  g+    + +++  R+
Fbh57312 188 IFAP--------TFVIYCGLRFVAAFGMAGIFLSSLTLMVEWTTTSRRAV 229 lgslyqlaitiGilvAaiiglglnktnndsalnswgWRiplglqlvpall
             ++    a  ++G+  Aa+  gl++++        WR +   ++vp   +
Fbh57312 230 TMTVVGCAFSAGQ--AALGGLAFAL-RD--------WRTLQLAASVPFFA 268 lliglllflPESPRwLvekgkleeArevLak...lrgvedvdqeiqeikae
             +++++lPES  RwL++ kgk  ++A    L++k   +++   ++++ +  ++
Fbh57312 269 ISLISWWLPESARWLIIKGKPDQALQELRKvarIN---GHKEAKNLTIEV 315 leagveee...kagkaswgelfrgrtrpkvrqrllmgvmlqafqQltGiN
             l  +v+ee   +++s+++lf    +      +r+r        ++  + +
Fbh57312 316 LMSSVKEEvasAKEPRSVLDLFCVPV---LRWRSCAMLVVNFSL------ 356 aifYYsptifksvGvsdsrasllvtiivgvvNfvfTlvaliflvDrfGRR
              i  YY+  ++   +  +  d    +1   +++g+v f+  +    1   +GRR
Fbh57312 357 LISYYGLVFDLQSLGRDI---FLLQALFGAVDFLGRATT-ALLLSFLGRR 402 plllGaagmaicflilgasigvalllnkpkdplskaagivaivfillf
              +  +++++++++i1          a++1+           +  +vf+ 1
Fbh57312 403 --TIQAGSQAMAGLAIL------ANMLVPQD-------LQTLRVVFAVLG 437 iafFalgwGpipwvilsElFPtkvRskalalataanwlanfiigflfpyi
             +F+++ +++  ++ +ElFPt  vR +a ++    +++l+++  +++ ++
Fbh57312 438 KGCFGISLTCLT-IYKAELFPTPVRMTADGILHTVGRLGAMMGPLILMS- 485 tgaiglalggyvflvfagllvlfilfvfffvPETKGrtLeeieelf<-*
              +a+         l+++++  l++v+ff+PET  G++L      +++
Fbh57312 486 RQALP----LLPPLLYGVISIASSLVVLFFLPETQGLPLPDTIQDL      527

FIG. 3

Protein Family / Domain Matches, HMMer version 2

```
Searching for complete domains in PFAM
hmmpfam - search a single seq against HMM database
HMMER 2.1.1
Copyright (C)           Washington University School of Medicine
HMMER is freely distributed under the GNU General Public License (GPL).
- - - - - - - - - - - - - - - - - - - - - - - - - - - - - - - - - - - -
HMM file:                /prod/ddm/seqanal/PFAM/pfam5.3/Pfam
Sequence file:           /prod/ddm/wspace/orfanal/oa-script.10175.seq
- - - - - - - - - - - - - - - - - - - - - - - - - - - - - - - - - - - -
Query:  Fbh53659pat Scores for sequence family classification (score includes all domains):
Model     Description                                  Score     E-value   N
-------   -----------                                  -----     -------   ---
sugar_tr  Sugar (and other) transporter                -177.1      1.4     1

Parsed for domains:
Model      Domain   seq-f  seq-t    hmm-f  hmm-t       score    E-value
--------   ------   -----  -----    -----  -----       -----    -------
sugar_tr    1/1      141    555 ..     1    487 []    -177.1      1.4

Alignments of top-scoring domains:
sugar_tr: domain 1 of 1, from 141 to 555: score -177.1, E = 1.4
                  *->valvaalgGgflfGyDtgviggflalidflfrfglltssgalaelgy
                     +l+  + +     yD+ ++   l+l  ++f +  +++    +
   Fbh53659pa  141   SSLTGLISS----SYDISFC--LLSLFVSFFGERGHKPRW-------  174 stvltglvvsifflGrliGslfaGklgdrfG.Rkkslliaivlf......
                     l ++++++G +G+l+++     + G+ k + l+    ++++++++
   Fbh53659pa  175   ------LAFAAFMIG--LGALVFSLPQFFSGeYKLGSLFEDTCVttrnst 216 viGallsgaapgytTiGlwafylliivGRvlvGlgvGgasvlvPmYisEiA
                     ++ +  s +++          +y++i+G +l+G g   + l + ++
   Fbh53659pa  217   SCTSSTSSLSN--------YLYVFILGQLLLGAGGTPLYTLGTAFLDDSV 258

PkalRGalgslyqlaitiGilvAaliglglnktnndsal........nsw
                     P+++  +++   ++ ++G +++ +g  1 +++ d a +++++ ++ +
   Fbh53659pa  259   PTHKSSLYIGTGYVMSILGPAIGYVLGGQLLTIYIDVAMgestdvteDDP 308 gWRiplglqlvpallllgllflPESPRwL.vekgkle.eArevLaklrg
                     W    +++++++    ++++l +P S   + + + g    e +A ++ +
   Fbh53659pa  309   RWLGAWWIGFLLS-WIFAWSLIIPFS-CFPkHLPGTAEiQAGKTSQAHQS 356 vedvdqeiqeikaeleagveeekagkaswgelfrgrtrpkvrqrllmgvm
                     ++ +d ++ + +    + a+          + l+ +       +++m+ +
   Fbh53659pa  357   NSNADVKFGKSIKDFPAA----------LKNLMKN--------AVFMCLV 388 lqa...fqQltGiNaifYYsptifksvGvsdsrasllvtiivgvv...Nf
                     l +++++ tG  + ++ + i ++ G+++s  + +t++ +v+ ++ +
   Fbh53659pa  389   LSTsseALITTG--FATFLPKFIENQFGLTSS---FAATLGGAVLipgAA 433 vfTlvaliflvDrfGRR......plllGaagmaicflilgasigvalll
                     +  + +  +flv +f +   +++  +++1+ +++ +++  f+++       + +
   Fbh53659pa  434   LGQILG-GFLVSKFRMTckntmkPALFTSGVALTLSFVFM------YAKC 476
```

FIG. 4A

```
                lnkpkdplskaagivaivfillfiafFalgwGpipwvilsElFPtkvRsk
                +n+p                          Fa  G      +sE + +++  +
Fbh53659pa  477 ENEP------------------------FA---G------VSESY-NGTGEL 494 alalataanwlanfiigflfpyitgaiglalggyvflvfagllvlfilfv
                +  +a + n  +n   ++ +p+  +       +++  + ++ + ++
Fbh53659pa  495 GNLIAPC-NANCNCSRSYYYPVCGDGVQ----YFSPCFAGCSNPVAHRKP 539 fffvPETKGrtLeeieelf<-*
                + + + ++    e   e+
Fbh53659pa  540 KVYYNCSCI---ERKTEIT     555
//
Searching for complete domains in SMART
hmmpfam - search a single seq against HMM database
HMMER 2.1.1 (DEC 1998)
Copyright (C) 1992-1998 Washington University School of Medicine
HMMER is freely distributed under the GNU General Public License (GPL).
- - - - - - - - - - - - - - - - - - - - - - - - - - - - - - - - -
HMM file:              /ddm/robison/smart/smart/smart.all.hmms
Sequence file:         /prod/ddm/wspace/orfanal/oa-script.10175.seq
- - - - - - - - - - - - - - - - - - - - - - - - - - - - - - - - -
Query:  Fbh53659pat Scores for sequence family classification (score includes all domains):
Model      Description                                Score    E-value  N
--------   -----------                                -----    -------  ---
kazal_3                                                -3.7       0.95  1

Parsed for domains:
Model      Domain   seq-f  seq-t    hmm-f  hmm-t       score  E-value
--------   ------   -----  -----    -----  -----       -----  -------
kazal_3     1/1       504    547 ..     1     58 []     -3.7     0.95

Alignments of top-scoring domains:
kazal_3: domain 1 of 1, from 504 to 547: score -3.7, E = 0.95
              *->dCseyrsptsggllaCpre.ydPVCGsDGvTYsNeCeLcaaaCeaeq
                 +C                +C+r  y PVCG DGv Y + C+  + +
Fbh53659pa 504   NC------------NCSRSyYYPVCG-DGVQYFSPCFAGCSNPV--A 535 gksievkhdGpC<-*
                 +++ +v ++ C
Fbh53659pa 536   HRKPKVYYNCSC     547
//
```

FIG. 4B

```
CLUSTAL W (1.74) multiple sequence alignment
Fbh53659pat    MKS-AKGIENLAFVPSSPDILRRLSASPSQIEVSALSSDPQRENSQPQELQKPQEPQKSP
hOATPe (AB031051) MPLHQLGDKPLTF-PS-PNSAMENGLDHTPPSRRASPGTPLSPGSLRSAAHSPLDTSKQP
               *  : *:* ** *:    . . . :  . *  .*  . :.* :..*.*

Fbh53659pat    EPSLPSAPPSVS-EEKLRSLSLSEFEEGSYGWRNFHPQCLQRCNTPGGFLLHYCLLAVTQ
hOATPe         LCQLWAEKHGARGTHEVRYVSAGQS--VACGWWAFAPPCLQVLNTPKGILFFLCAAAFLQ
               .* :  ..  .::* :* .:   : ** * *** *** *:*:. * *. *

Fbh53659pat    GIVVNGLVNISISTVEKRYEMKSSLTGLISSSYDISFCLLSLFVSFFGERGHKPRWLAFA
hOATPe         GMTVNGFINTVITSLERRYDLHSYQSGLIASSYDIAACLCLTFVSYFGGSGHKPRWLGWG
               *:.***::* *:::*:**:::* :***:***** ** ***:** *******.:.

Fbh53659pat    AFMIGLGALVFSLPQFFSGEYKLG-SLFEDTCVTTRNSTSCTSSTSSLSNYLYVFILGQL
hOATPe         VLLMGTGSLVFALPHFTAGRYEVELDAGVRTCPANPG-AVCADSTGLSRYQLVFMLGQF
               .:::* *:***:**:* :*.*::  .  ** :..:  *:.***.**.* **:***:

Fbh53659pat    LLGAGGTPLYTLGTAFLDDSVPTHKSSLYIGTGYVMSILGPAIGYVLGGQLLTIYIDVAM
hOATPe         LHGVGATPLYTLGVTYLDENVKSSCSPVYIAIFYTAAILGPAAGYLIGGALLNIYT--EM
               * *.*.********. :**:.* :  *  *.:** . :***** **:.***  *.**   *

Fbh53659pat    GESTDVTEDDPRWLGAWWIGFLLSWIFAWSLIIPFSCFPKHLPGTAEIQAGKTSQAHQS-
hOATPe         GRRTELTTESPLWVGAWWVGFLGSGAAAFFTAVPILGYPRQLPGSQRYAVMRAAEMHQLK
               *.  *::*  :.*  *:****:***  *    *: :*: :*::***:  .   .  ::::  **

Fbh53659pat    NSN----ADVKFGKSIKDFPAALKNLMKNAVFMCLVLSTSSEALITTGFATFLPKFIENQ
hOATPe         DSSRGEASNPDFGKTIRDLPLSIWLLLKNPTFILLCLAGATEATLITGMSTFSPKFLESQ
               :*.    ::  .***:*:*:**  ::  *:**..*: * *:  ::** : **::** ***:*.*

Fbh53659pat    FGLTSSFAATLGGAVLIPGAALGQILGGFLVSKFRMTCKNTMKFALFTSGVALTLSFVFM
hOATPe         FSLSASEAATLFGYLVVPAGGGGTFLGGFFVNKLRLRGSAVIKFCLFCTVVSLLGILVFS
               *.*::* ****  *  :::*...  * :*****.*:*:*:. . .:**.** : *:*   :**

Fbh53659pat    YAKCENEPFAGVSESYNGTG-ELG--NLIAPCNANCNCSRSYYYPVCG-DGVQYFSPCFA
hOATPe         LH-CPSVPMAGVTASYGGSLLPEGHLNLTAPCNAACSCQPEHYSPVCGSDGLMYFSLCHA
               :  .*.. *:*** :**.*:   *  ** ***** *.* ..:* ****   ***  *.*

Fbh53659pat    GC--SNPVAHRKPKVYYNCSCIERKTEITSTAETFGFEAKAGKCETHCAKLPIFLCIFFI
hOATPe         GCPAATETNVDGQKVYRDCSCIPQN--LSS---GFG-HATAGKCTSTCQRKPLLLVPIFV
               **   :.  . .   *** :**** ::   ::*   **  .****  *:* .  ::*:*:

Fbh53659pat    VIIFTFMAGTPITVSILRCVNHRQRSLALGIQFMVLRLLGTIPGPIIFGFTIDSTCILWD
hOATPe         VIFFTFLSSIPALTATLRCVRDPQRSFALGIQWIVVRILGGIPGPIAFGWVIDKACLLWQ
               **:****:::.*  .: .****::****.****  :*:*:**:****** ****: .**:*:

Fbh53659pat    INDCGIKGACWIYDNIKMAHMLVAISVTCKVITMFFNGFAIFLYKPPPSATD---VSFHK
hOATPe         -DQCGQQGSCLVYQNSAMSRYILIMGLLYKVLGVLFFAIACFLYKPLSESSDGLETCLPS
               ::**  :*:* :*:*  *::  ::   :.:  **: :* ..:***** ..::*    ..: .

Fbh53659pat    ENAVVTNVLAEQDLNKIVKEG
hOATPe         QSSAPDSATDSQLQSSV----
               :.:.  .. .* ..:
```

FIG. 5

> Fbh53659FL

```
AAGCTTCCCGCACGGGGGCGCTGTCACCTGCCTGTGGGAGGAGCCAGAGAGGGACCTGGC
TCTGCTGCTCTGAAGCACCGGAGTCGGGAGAACCCATCCAGACATGAAGAGCGCCAAAGG
TATTGAGAACTTGGCTTTTGTCCCCTCCAGCCCAGACATCCTGCGCCGCTTGTCTGCGTC
GCCCTCCCAAATCGAAGTCTCTGCCTTGTCCTCTGACCCCCAAAGAGAGAATTCTCAGCC
ACAGGAGCTTCAGAAGCCCCAGGAGCCCCAGAAGTCACCAGAGCCATCTCTGCCTTCAGC
CCCTCCCAGTGTCTCCGAAGAGAAGCTCCGGTCACTGTCGCTGTCCGAGTTTGAGGAGGG
GTCTTACGGCTGGAGGAACTTCCATCCTCAATGTCTCCAGCGCTGCAACACACCTGGAGG
CTTTCTGCTTCACTACTGCCTCTTGGCCGTCACGCAAGGTATTGTAGTTAATGGCCTAGT
AAATATTAGCATTTCCACTGTTGAGAAGCGTTATGAAATGAAGAGTTCCCTGACTGGCCT
GATTTCATCAAGCTACGATATTTCATTCTGTTTGTTGTCTTTATTTGTATCATTCTTTGG
TGAAAGAGGACATAAGCCGAGATGGCTTGCATTTGCAGCCTTTATGATTGGACTGGGAGC
ACTTGTATTCTCATTGCCACAATTTTTCAGTGGAGAATATAAATTGGGGTCTCTTTTTGA
AGACACTTGTGTAACAACAAGGAATAGCACCAGTTGTACATCTTCAACTTCTTCACTTTC
TAACTACTTGTATGTCTTCATCTTGGGACAACTATTGCTGGGGGCAGGAGGAACTCCTCT
TTATACTCTGGGAACAGCCTTTCTTGATGATTCTGTGCCCACACACAAGTCTTCTCTCTA
TATAGGAACCGGTTATGCTATGTCAATCTTAGGCCCTGCTATTGGCTATGTATTGGGAGG
ACAACTGCTAACCATATACATTGATGTTGCTATGGGAGAAAGCACTGATGTCACTGAGGA
TGATCCGCGATGGTTGGGAGCTTGGTGGATTGGGTTTCTTCTATCATGGATCTTTGCTTG
GTCTTTAATAATACCTTTTTCTTGCTTTCCAAAACATTTACCAGGTACAGCAGAAATTCA
AGCTGGAAAAACTTCCCAGGCTCATCAGAGTAATAGTAATGCAGATGTGAAATTTGGAAA
AAGTATTAAAGATTTTCCAGCTGCTCTAAAGAATTTGATGAAGAATGCTGTCTTTATGTG
TTTAGTTCTATCAACTTCTTCAGAAGCCTTAATTACTACTGGATTTGCTACATTTTTACC
TAAATTTATAGAAAATCAATTCGGATTGACATCCAGCTTCGCAGCTACTCTTGGAGGGGC
TGTTTTAATTCCTGGAGCTGCTCTCGGTCAAATTTTAGGTGGCTTCCTTGTTTCAAAATT
CAGAATGACATGTAAAAACACAATGAAGTTTGCACTGTTCACATCTGGAGTTGCACTTAC
GCTGAGTTTTGTATTTATGTATGCCAAATGTGAAAATGAGCCATTTGCTGGTGTATCTGA
ATCATATAATGGGACTGGAGAATTGGGAAACTTGATAGCCCCTTGTAATGCCAATTGTAA
CTGTTCGCGATCATATTATTATCCTGTCTGTGGAGATGGAGTCCAATATTTTTCTCCCTG
CTTTGCAGGCTGTTCAAACCCAGTTGCACACAGGAAGCCAAAGGTATATTACAACTGTTC
CTGTATTGAAAGGAAAACAGAAATAACATCCACTGCAGAAACTTTTGGTTTTGAAGCTAA
AGCTGGAAAATGTGAAACTCATTGTGCGAAACTGCCCATATTCCTTTGCATTTTCTTTAT
TGTAATTATTTTTACCTTTATGGCCGGTACTCCTATAACTGTGTCTATCCTAAGGTGTGT
TAATCACAGACAACGGTCCCTAGCCTTGGGAATACAATTTATGGTCCTTCGATTATTAGG
GACAATTCCTGGACCAATTATATTTGGTTTCACAATAGACAGCACATGTATTCTTTGGGA
TATAAATGATTGTGGAATTAAAGGAGCTTGCTGGATTTATGATAACATCAAGATGGCCCA
TATGCTAGTAGCCATAAGTGTTACTTGTAAAGTTATCACCATGTTCTTCAATGGATTTGC
AATCTTTTTGTATAAACCACCTCCATCAGCCACAGATGTGTCATTTCATAAAGAGAATGC
AGTTGTGACTAATGTTTTAGCAGAACAGGATCTCAACAAAATAGTAAAAGAAGGGTGAAA
TGGGAAAAGAGAAGACTGTTTTACACCTGGAAAATTTACCTCGATTTTTAAGAACACACA
TTGCCATGGCAGGATTATCTATCCAATATGGACAATCATATTTACAAAATTGATGTTTTT
ATAATCAAATGTATTTTTTTACTTATGTAGTTTTTGTTTTATGCAAGAAACAGACCTGTG
CCTTCAAAGCCCACGTAAAGCCTCAAAACACAGCACACACACACACGAGCACACACACAC
ACACACACACGAACACACACACACACACACACACGCACACATACACACTTATTTCCTATT
CCCATTGTCTAGGTATGAAATCCTCAAGCAAAAAAAAAAAAAAAGGGCGGCCGC
```

FIG. 6

OAT5 MOLECULES AND USES THEREFOR

RELATED APPLICATIONS

This application is a continuation-in-part of U.S. patent application Ser. No. 09/858,194, filed May 14, 2001 now abandoned, which claims the benefit of U.S. Provisional Application Ser. No. 60/204,211, filed May 12, 2000.

This application is also a continuation-in-part of U.S. patent application Ser. No. 09/895,811, filed Jun. 29, 2001 now abandoned, which claims the benefit of U.S. Provisional Application Ser. No. 60/215,376, filed June 29, 2000.

This application is also a continuation-in-part of U.S. patent application Ser. No. 09/919,781, filed Jul. 31, 2001 now abandoned, which claims the benefit of U.S. Provisional Application Ser. No. 60/221,769, filed Jul. 31, 2000.

This application is also a continuation-in-part of U.S. patent application Ser. No. 09/957,664, filed September 19, 2001 now abandoned, which claims the benefit of U.S. Provisional Application Ser. No. 60/233,790, filed Sep. 19, 2000.

This application is also a continuation-in-part of U.S. patent application Ser. No. 09/964,295, filed Sep. 25, 2001 now abandoned, which claims the benefit of U.S. Provisional Application Ser. No. 60/235,107, filed Sep. 25, 2000.

This application is also a continuation-in-part of U.S. patent application Ser. No. 09/972,724, now abandoned filed Oct. 5, 2001, which claims the benefit of U.S. Provisional Application Ser. No. 60/238,336, filed Oct. 5, 2000.

This application is also a continuation-in-part of U.S. patent application Ser. No. 10/002,769, filed November 14, 2001 now abandoned, which claims the benefit of U.S. Provisional Application Ser. No. 60/248,364, filed Nov. 14, 2000, and U.S. Provisional Application Ser. No. 60/248,878, filed Nov. 15, 2000.

This application is also a continuation-in-part of U.S. patent application Ser. No. 10/024,623, filed Dec. 17, 2001 (pending), which claims the benefit of U.S. Provisional Application Ser. No. 60/256,240, filed Dec. 15, 2000, U.S. Provisional Application Ser. No. 60/256,588, filed Dec. 18, 2000, and U.S. Provisional Application Ser. No. 60/258,028, filed Dec. 21, 2000.

This application is also a continuation-in-part of U.S. patent application Ser. No. 10/055,025, filed Jan. 22, 2002 now abandoned, which claims the benefit of U.S. Provisional Application Ser. No. 60/263,169, filed Jan. 22, 2001.

This application also claims the benefit of U.S. Provisional Application Ser. No. 60/324,016, filed Sep. 20, 2001 (pending).

The entire contents of each of the above-referenced patent applications are incorporated herein by this reference.
57312 AND 53659, Novel Human Organic Anion Transporter Molecules and Uses Thereof

BACKGROUND OF THE INVENTION

Cellular membranes serve to differentiate the contents of a cell from the surrounding environment, and may also serve as effective barriers against the unregulated influx of hazardous or unwanted compounds, and the unregulated efflux of desirable compounds. Membranes are by nature impervious to the unfacilitated diffusion of hydrophilic compounds such as proteins, water molecules, and ions due to their structure: a bilayer of lipid molecules in which the polar head groups face outwards (towards the exterior and interior of the cell) and the nonpolar tails face inwards (at the center of bilayer, forming a hydrophobic core). Membranes enable a cell to maintain a relatively higher intracellular concentration of desired compounds and a relatively lower intracellular concentration of undesired compounds than are contained within the surrounding environment.

However, membranes also present a structural difficulty for cells, in that most desired compounds cannot readily enter the cell, nor can most waste products readily exit the cell through this lipid bilayer. The import and export of such compounds is facilitated by proteins which are embedded (singly or in complexes) in the cellular membrane. There are several general classes of membrane transport proteins: channels/pores, permeases, and transporters. The former are integral membrane proteins which form a regulated passage through a membrane. This regulation, or 'gating' is generally specific to the molecules to be transported by the pore or channel, rendering these transmembrane constructs selectively permeable to a specific class of substrates. For example, a calcium channel is constructed such that only ions having a like charge and size to that of calcium may pass through. Channel and pore proteins tend to have discrete hydrophobic and hydrophilic domains, such that the hydrophobic face of the protein may associate with the interior of the membrane while the hydrophilic face lines the interior of the channel, thus providing a sheltered hydrophilic environment through which the selected hydrophilic molecule may pass. This pore/channel-mediated system of facilitated diffusion is limited to ions and other very small molecules, due to the fact that pore or channels sufficiently large to permit the passage of whole proteins by facilitated diffusion would be unable to prevent the simultaneous passage of smaller hydrophilic molecules.

Transport of larger molecules takes place by the action of 'permeases' and 'transporters', two other classes of membrane-localized proteins which serve to move charged molecules from one side of a cellular membrane to the other. Unlike channel molecules, which permit diffusion-limited solute movement of a particular solute, these proteins require an energetic input, either in the form of a diffusion gradient (permeases) or through coupling to hydrolysis of an energetic molecule (e.g., ATP or GTP) (transporters). The permeases, integral membrane proteins often having between 6–14 membrane-spanning α-helices, enable the facilitated diffusion of molecules such as glucose or other sugars into the cell when the concentration of these molecules on one side of the membrane is greater than that on the other. Permeases do not form open channels through the membrane, but rather bind to the target molecule at the surface of the membrane and then undergo a conformational shift such that the target molecule is released on the opposite side of the membrane.

Transporters, in contrast, permit the movement of target molecules across membranes against the existing concentration gradient (active transport), a situation in which facilitated diffusion cannot occur. There are two general mechanisms used by cells for this type of membrane transport: symport/antiport, and energy-coupled transport, such as that mediated by the ABC transporters. Symport and antiport systems couple the movement of two different molecules across the membrane (via molecules having two separate binding sites for the two different molecules); in symport, both molecules are transported in the same direction, while in antiport, one molecule is imported while the other is exported. This is possible energetically because one of the two molecules moves in accordance with a concentration gradient, and this energetically favorable event is permitted only upon concomitant movement of a desired compound against the prevailing concentration gradient.

Single molecules may also be transported across the membrane against the concentration gradient in an energy-driven process, such as that utilized by the ABC transporters. In this ABC transporter system, the transport protein located in the membrane has an ATP-binding cassette; upon binding of the target molecule, the ATP is converted to ADP and inorganic phosphate ($P_i$), and the resulting release of energy is used to drive the movement of the target molecule to the opposite face of the membrane, facilitated by the transporter.

Transport molecules are specific for a particular target solute or class of solutes, and are also present in one or more specific membranes. Transport molecules localized to the plasma membrane permit an exchange of solutes with the surrounding environment, while transport molecules localized to intracellular membranes (e.g., membranes of the mitochondrion, peroxisome, lysosome, endoplasmic reticulum, nucleus, or vacuole) permit import and export of molecules from organelle to organelle or to the cytoplasm. For example, in the case of the mitochondrion, transporters in the inner and outer mitochondrial membranes permit the import of sugar molecules, calcium ions, and water (among other molecules) into the organelle and the export of newly synthesized ATP to the cytosol.

Membrane transport molecules (e.g., channels/pores, permeases, and transporters) play important roles in the ability of the cell to regulate homeostasis, to grow and divide, and to communicate with other cells, e.g., to secrete and receive signaling molecules, such as hormones, reactive oxygen species, ions, neurotransmitters, and cytokines. A wide variety of human diseases and disorders are associated with defects in transporter or other membrane transport molecules, including certain types of liver disorders (e.g., due to defects in transport of long-chain fatty acids (Al Odaib et al. (1998) *New Eng. J. Med.* 339:1752–1757), hyperlysinemia (due to a transport defect of lysine into mitochondria (Oyanagi et al. (1986) *Inherit. Metab. Dis.* 9:313–316), and cataract (Wintour (1997) *Clin. Exp. Pharmacol. Physiol.* 24(1):1–9).

Organic anion transporters are a particular subclass of transporters which are specific for the transport of organic anions, which include a wide variety of drugs and xenobiotics, many of which are harmful to the body. In addition, organic ion transporters are responsible for the transport of the metabolites of most lipophilic compounds, e.g., sulfate and glucuronide conjugates (Moller, J. V. and Sheikh, M. I. (1982) *Pharmacol. Rev.* 34:315–358; Pritchard, J. B. and Miller, D. S. (1993) *Physiol. Rev.* 73:765–796; Ullrich, K. J. (1997) *J. Membr. Biol.* 158:95–107; Ullrich, K. J. and Rumrich, G. (1993) *Clin. Investig.* 71:843–848; Petzinger, E. (1994) *Rev. Physiol. Biochem. Pharmacol.* 123:47–211).

SUMMARY OF THE INVENTION

The present invention is based, at least in part, on the discovery of novel organic anion transporter family members, referred to herein as "Organic Anion Transporter" or "OAT" nucleic acid and protein molecules (e.g., OAT4 and OAT5). The OAT nucleic acid and protein molecules of the present invention are useful as modulating agents in regulating a variety of cellular processes, e.g., protection of cells and/or tissues from organic anions, organic anion transport, inter- or intra-cellular signaling, and/or hormonal responses. Accordingly, in one aspect, this invention provides isolated nucleic acid molecules encoding OAT proteins or biologically active portions thereof, as well as nucleic acid fragments suitable as primers or hybridization probes for the detection of OAT-encoding nucleic acids.

In one embodiment, the invention features an isolated nucleic acid molecule that includes the nucleotide sequence set forth in SEQ ID NO:4, 6, 7, or 9. In another embodiment, the invention features an isolated nucleic acid molecule that encodes a polypeptide including the amino acid sequence set forth in SEQ ID NO:5 or 8.

In still other embodiments, the invention features isolated nucleic acid molecules including nucleotide sequences that are substantially identical (e.g., 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% identical) to the nucleotide sequence set forth as SEQ ID NO:4, 6, 7, or 9. The invention further features isolated nucleic acid molecules including at least 30 contiguous nucleotides of the nucleotide sequence set forth as SEQ ID NO:4, 6, 7, or 9. In another embodiment, the invention features isolated nucleic acid molecules which encode a polypeptide including an amino acid sequence that is substantially identical (e.g., 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% identical) to the amino acid sequence set forth as SEQ ID NO:5 or 8. Also featured are nucleic acid molecules which encode allelic variants of the polypeptide having the amino acid sequence set forth as SEQ ID NO:5 or 8. In addition to isolated nucleic acid molecules encoding full-length polypeptides, the present invention also features nucleic acid molecules which encode fragments, for example, biologically active or antigenic fragments, of the full-length polypeptides of the present invention (e.g., fragments including at least 10 contiguous amino acid residues of the amino acid sequence of SEQ ID NO:5 or 8). In still other embodiments, the invention features nucleic acid molecules that are complementary to, antisense to, or hybridize under stringent conditions to the isolated nucleic acid molecules described herein.

In a related aspect, the invention provides vectors including the isolated nucleic acid molecules described herein (e.g., OAT-encoding nucleic acid molecules). Such vectors can optionally include nucleotide sequences encoding heterologous polypeptides. Also featured are host cells including such vectors (e.g., host cells including vectors suitable for producing OAT nucleic acid molecules and polypeptides).

In another aspect, the invention features isolated OAT polypeptides and/or biologically active or antigenic fragments thereof. Exemplary embodiments feature a polypeptide including the amino acid sequence set forth as SEQ ID NO:5 or 8, a polypeptide including an amino acid sequence at least 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% identical to the amino acid sequence set forth as SEQ ID NO:5 or 8, a polypeptide encoded by a nucleic acid molecule including a nucleotide sequence at least 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% identical to the nucleotide sequence set forth as SEQ ID NO:4, 6, 7, or 9. Also featured are fragments of the full-length polypeptides described herein (e.g., fragments including at least 10, 15, 20, 25, 30, 35, 40, 45, or 50 contiguous amino acid residues of the sequence set forth as SEQ ID NO:5 or 8) as well as allelic variants of the polypeptide having the amino acid sequence set forth as SEQ ID NO:5 or 8.

The OAT polypeptides and/or biologically active or antigenic fragments thereof, are useful, for example, as reagents or targets in assays applicable to treatment and/or diagnosis of OAT associated disorders. In one embodiment, an OAT polypeptide or fragment thereof has an OAT activity. In another embodiment, an OAT polypeptide or fragment thereof has at least one of the following domains: a transmembrane domain, a sugar (and other) transporter domain, and/or an ATP/GTP-binding site motif A (P-loop) domain, and optionally, has an OAT activity. In a related aspect, the invention features antibodies (e.g., antibodies which specifically bind to any one of the polypeptides, as described herein) as well as fusion polypeptides including all or a fragment of a polypeptide described herein.

The present invention further features methods for detecting OAT polypeptides and/or OAT nucleic acid molecules, such methods featuring, for example, a probe, primer or antibody described herein. Also featured are kits for the detection of OAT polypeptides and/or OAT nucleic acid molecules. In a related aspect, the invention features methods for identifying compounds which bind to and/or modulate the activity of an OAT polypeptide or OAT nucleic acid molecule described herein. Also featured are methods for modulating an OAT activity.

Other features and advantages of the invention will be apparent from the following detailed description and claims.

BRIEF DESCRIPTION OF THE DRAWINGS

FIGS. 1A–B depict the nucleotide sequence of the human OAT4 cDNA (clone Fbh57312) and the corresponding amino acid sequence. The nucleotide sequence corresponds to nucleotides 1 to 2206 of SEQ ID NO:4. The amino acid sequence corresponds to amino acids 1 to 550 of SEQ ID NO:5. The coding region without the 5' or 3' untranslated regions of the human OAT4 gene is shown in SEQ ID NO:6.

FIGS. 2A–B depict the coding sequence of the human OAT5 cDNA (clone Fbh53659) and the corresponding amino acid sequence. The coding sequence corresponds to nucleotides 1 to 2172 of SEQ ID NO:9 and nucleotides 104–2275 of SEQ ID NO:7. The amino acid sequence corresponds to amino acids 1 to 724 of SEQ ID NO:8.

FIG. 3 depicts the results of a search in the HMM database using the amino acid sequence of human OAT4.

FIGS. 4A–B depicts the results of a search in the HMM database using the amino acid sequence of human OAT5.

FIG. 5 depicts an alignment of the human OAT5 gene with the human OATPe gene (GenBank Accession No. AB031051; SEQ ID NO:10). Identical amino acid residues are indicated by stars.

FIG. 6 depicts the full-length nucleotide sequence of the human OAT5 cDNA (clone Fbh57312). The nucleotide sequence corresponds to nucleotides 1 to 2634 of SEQ ID NO:7.

DETAILED DESCRIPTION OF THE INVENTION

Figure 7:
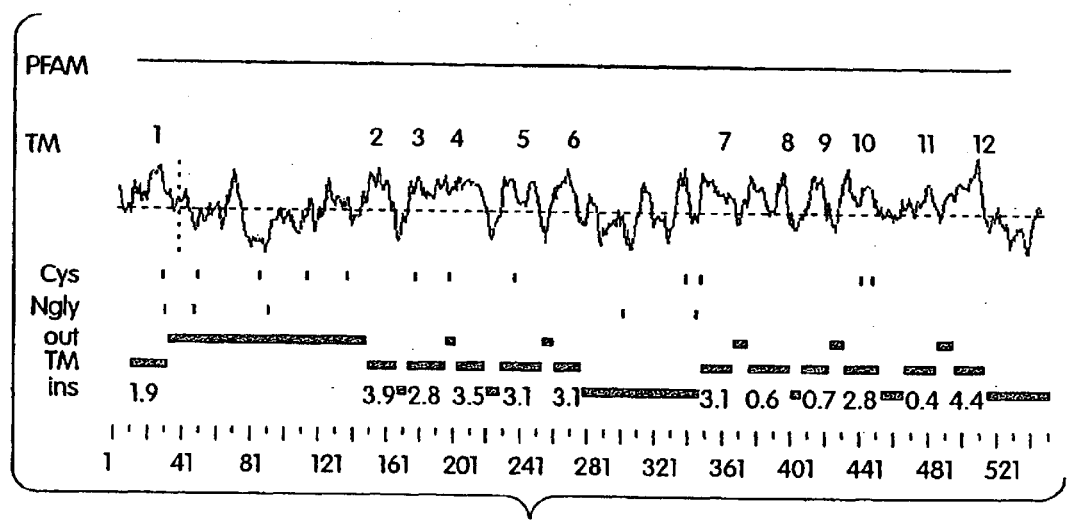
FIG. 7 depicts a structural, hydrophobicity, and antigenicity analysis of the human OAT4 protein. The locations of the 12 transmembrane domains are indicated (TIM 1, 2, 3, etc.).

The present invention is based, at least in part, on the discovery of novel organic anion transporter family members, referred to herein as "Organic anion transporter" or "OAT" nucleic acid and protein molecules, e.g., OAT4 and OAT5. These novel molecules are capable of transporting organic anions (e.g., drugs, xenobiotics, and/or metabolites of lipophilic compounds such as sulfate and glucuronide conjugates) across cellular membranes and, thus, play a role in or function in a variety of cellular processes, e.g., protection of cells and/or tissues from organic anions, organic anion transport, inter- or intra-cellular signaling, and/or hormonal responses. Thus, the OAT molecules of the present invention provide novel diagnostic targets and therapeutic agents to control organic anion transporter-associated disorders.

As used herein, an "organic anion transporter-associated disorder" or an "OAT-associated disorder" includes a disorder, disease or condition which is caused or characterized by a misregulation (e.g., downregulation or upregulation) of organic anion transporter activity. Organic anion transporter-associated disorders can detrimentally affect cellular functions such as cellular proliferation, growth, differentiation, or migration, inter- or intra-cellular communication; tissue function, such as cardiac function or musculoskeletal function; systemic responses in an organism, such as nervous system responses, hormonal responses (e.g., insulin response); immune responses; and protection of cells from toxic compounds (e.g., carcinogens, toxins, or mutagens).

Examples of organic anion transporter-associated disorders include CNS disorders such as cognitive and neurodegenerative disorders, examples of which include, but are not limited to, Alzheimer's disease, dementias related to Alzheimer's disease (such as Pick's disease), Parkinson's and other Lewy diffuse body diseases, senile dementia, Huntington's disease, Gilles de la Tourette's syndrome, multiple sclerosis, amyotrophic lateral sclerosis, progressive supranuclear palsy, epilepsy, and Jakob-Creutzfieldt disease; autonomic function disorders such as hypertension and sleep disorders, and neuropsychiatric disorders, such as depression, schizophrenia, schizoaffective disorder, korsakoff's psychosis, mania, anxiety disorders, or phobic disorders; learning or memory disorders, e.g., amnesia or age-related memory loss, attention deficit disorder, dysthymic disorder, major depressive disorder, mania, obsessive-compulsive disorder, psychoactive substance use disorders, anxiety, phobias, panic disorder, as well as bipolar affective disorder, e.g., severe bipolar affective (mood) disorder (BP-1), and bipolar affective neurological disorders, e.g., migraine and obesity. Further CNS-related disorders include, for example, those listed in the American Psychiatric Association's Diagnostic and Statistical manual of Mental Disorders (DSM), the most current version of which is incorporated herein by reference in its entirety.

Further examples of organic anion transporter-associated disorders include cardiac-related disorders. Cardiovascular system disorders in which the OAT molecules of the invention may be directly or indirectly involved include arteriosclerosis, ischemia reperfusion injury, restenosis, arterial inflammation, vascular wall remodeling, ventricular remodeling, rapid ventricular pacing, coronary microembolism, tachycardia, bradycardia, pressure overload, aortic bending, coronary artery ligation, vascular heart disease, atrial fibrillation, Jervell syndrome, Lange-Nielsen syndrome, long-QT syndrome, congestive heart failure, sinus node dysfunction, angina, heart failure, hypertension, atrial fibrillation, atrial flutter, dilated cardiomyopathy, idiopathic cardiomyopathy, myocardial infarction, coronary artery disease, coronary artery spasm, and arrhythmia. OAT-mediated or related disorders also include disorders of the musculoskeletal system such as paralysis and muscle weakness, e.g., ataxia, myotonia, and myokymia.

Organic anion transporter disorders also include cellular proliferation, growth, differentiation, or migration disorders. Cellular proliferation, growth, differentiation, or migration disorders include those disorders that affect cell proliferation, growth, differentiation, or migration processes. As used herein, a "cellular proliferation, growth, differentiation, or migration process" is a process by which a cell increases in number, size or content, by which a cell develops a specialized set of characteristics which differ from that of other cells, or by which a cell moves closer to or further from a particular location or stimulus. The OAT molecules of the present invention are involved in signal transduction mechanisms, which are known to be involved in cellular growth, differentiation, and migration processes. Thus, the OAT molecules may modulate cellular growth, differentiation, or migration, and may play a role in disorders characterized by aberrantly regulated growth, differentiation, or migration. Such disorders include cancer, e.g., carcinoma, sarcoma, or leukemia; tumor angiogenesis and metastasis; skeletal dysplasia; hepatic disorders; and hematopoietic and/or myeloproliferative disorders.

OAT-associated or related disorders also include hormonal disorders, such as conditions or diseases in which the production and/or regulation of hormones in an organism is aberrant. Examples of such disorders and diseases include type I and type II diabetes mellitus, pituitary disorders (e.g., growth disorders), thyroid disorders (e.g., hypothyroidism or hyperthyroidism), and reproductive or fertility disorders (e.g., disorders which affect the organs of the reproductive system, e.g., the prostate gland, the uterus, or the vagina; disorders which involve an imbalance in the levels of a reproductive hormone in a subject; disorders affecting the ability of a subject to reproduce; and disorders affecting secondary sex characteristic development, e.g., adrenal hyperplasia).

Further examples of OAT-associated or related disorders also include immune disorders, such as autoimmune disorders or immune deficiency disorders, e.g., allergies, transplant rejection, responses to pathogenic infection (e.g., bacterial, viral, or parasitic infection), lupus, multiple sclerosis, congenital X-linked infantile hypogammaglobulinemia, transient hypogammaglobulinemia, common variable immunodeficiency, selective IgA deficiency, chronic mucocutaneous candidiasis, or severe combined immunodeficiency.

DHDR-associated or related disorders also include viral disorders, i.e., disorders affected or caused by infection by a virus, e.g., hepatitis, AIDS, certain cancers, influenza, and common colds.

OAT-associated or related disorders also include disorders affecting tissues in which OAT protein is expressed, e.g., the kidney, osteoblasts, brain cortex, lung, liver, bone marrow mononuclear cells (BM-MNC), and neutrophils.

The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin or alternatively, can contain homologues of non-human origin, e.g., rat or mouse proteins. Members of a family can also have common functional characteristics.

For example, the family of OAT proteins of the present invention comprises at least one "transmembrane domain". As used herein, the term "transmembrane domain" includes an amino acid sequence of about 15 amino acid residues in length which spans the plasma membrane. More preferably, a transmembrane domain includes about at least 20, 25, 30, 35, 40, or 45 amino acid residues and spans the plasma membrane. Transmembrane domains are rich in hydrophobic residues, and typically have an alpha-helical structure. In a preferred embodiment, at least 50%, 60%, 70%, 80%, 90%, 95% or more of the amino acids of a transmembrane domain are hydrophobic, e.g., leucines, isoleucines, tyrosines, or typtophans. Transmembrane domains are described in, for example, Zagotta, W. N. et al. (1996) *Annu. Rev. Neurosci.* 19:235–263, the contents of which are incorporated herein by reference. Amino acid residues 10–31, 148–165, 172–195, 202–219, 228–252, 26–276, 347–365, 375–399, 406–422, 431451, 466484, and 495–512 of the human OAT4 protein are predicted to comprise transmembrane domains (see FIG. 7). Amino acid residues 106–130, 143–166, 174–191, 230–254, 265–284, 314–335, 382–405, 419–443, 456–473, 579–603, 613–636, and 667–690 of the human OAT5 protein are predicted to comprise transmembrane domains (see FIG. 5). Accordingly, OAT proteins having at least 50–60% homology, preferably about 60–70%, more preferably about 70–80%, or about 80–90% homology with a transmembrane domain of human OAT are within the scope of the invention.

In another embodiment, members of the OAT family of proteins, include at least one "sugar (and other) transporter domain" in the protein or corresponding nucleic acid molecule. As used herein, the term "sugar (and other) transporter domain" includes a protein domain having at least about 335–505 amino acid residues. Preferably, a sugar (and other) transporter domain includes a protein domain having an amino acid sequence of about 355–485, 375–465, 395–445, or more preferably about 415–425 amino acid residues, and a bit score of at least 10, 20, 30, or more preferably, 34.7. To identify the presence of a sugar (and other) transporter domain in an OAT protein, and make the determination that a protein of interest has a particular profile, the amino acid sequence of the protein is searched against a database of known protein domains (e.g., the HMM database). The sugar (and other) transporter domain (HMM) has been assigned the PFAM Accession number PF00083 (see the PFAM website, available online through Washington University in St. Louis). A search was performed against the HMM database resulting in the identification of a sugar (and other) transporter domain in the amino acid sequence of human OAT4 at about residues 103–527 of SEQ ID NO:5. The results of the search are set forth in FIG. 3. Another search was performed against the HMM database, further resulting in the identification of a sugar (and other) transporter domain in the amino acid sequence of human OAT5 at about residues 141–555 of SEQ ID NO:8. The results of the search are set forth in FIGS. 4A–B.

A description of the Pfam database can be found in Sonhammer et al. (1997) *Proteins* 28:405420, and a detailed description of HMMs can be found, for example, in Gribskov et al. (1990) *Meth. Enzymol.* 183:146–159; Gribskov et al. (1987) *Proc. Natl. Acad. Sci. USA* 84:43554358; Krogh et al. (1994) *J. Mol. Biol.* 235:1501–1531; and Stultz et al. (1993) *Protein Sci.* 2:305–314, the contents of which are incorporated herein by reference.

In another embodiment, an OAT protein of the present invention includes at least one "ATP/GTP-binding site motif A (P-loop) domain". As used herein, the term "ATP/GTP-binding site motif A (P-loop) domain" includes an amino acid sequence having the consensus sequence [AG]-X(4)-G-K-[ST] (SEQ ID NO: 11). ATP/GTP-binding site motif A (P-loop) domains are described under Prosite entry PS00017 (see the Prosite website, available online through the Swiss Institute for Bioinformatics). The consensus sequence described herein is described according to the standard Prosite signature designation (e.g., all amino acids are indicated according to their universal single letter designation; X designates any amino acid; X(n) designates any n amino acids, e.g., X(4) designates any 4 amino acids; [AG] indicates any one of the amino acids appearing within the brackets, e.g., any one of A or G). Searches were performed against the Prosite database resulting in the identification of two ATP/GTP-binding site motif A (P-loop) domains in the amino acid sequence of OAT5 at about residues 343–350 and 360–367 of SEQ ID NO:8.

Isolated proteins of the present invention, preferably OAT proteins, have an amino acid sequence sufficiently homologous to the amino acid sequence of SEQ ID NO:5 or 8, or are encoded by a nucleotide sequence sufficiently homologous to SEQ ID NO:4, 6, 7, or 9. As used herein, the term "sufficiently homologous" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains having at least 50%, 55%, 60%, 65%, 70%, 75%, 80%, 85%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more homology or identity across the amino acid sequences of the domains and contain at least one and preferably two structural domains or motifs, are defined herein as sufficiently homologous. Furthermore, amino acid or nucleotide sequences which share at least 50%, 55%, 60%, 65%, 70%, 75%, 80%, 85%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more homology or identity and share a common functional activity are defined herein as sufficiently homologous.

In a preferred embodiment, an OAT protein includes at least one of the following domains: a transmembrane domain, a sugar (and other) transporter domain, and/or an ATP/GTP-binding site motif A (P-loop) domain, and has an amino acid sequence at least about 50%, 55%, 60%, 65%, 70%, 75%, 80%, 85%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more homologous or identical to the amino acid sequence of SEQ ID NO:5 or 8 In yet another preferred embodiment, an OAT protein includes at least one of the following domains: a transmembrane domain, a sugar (and other) transporter domain, and/or an ATP/GTP-binding site motif A (P-loop) domain, and is encoded by a nucleic acid molecule having a nucleotide sequence which hybridizes under stringent hybridization conditions to a complement of a nucleic acid molecule comprising the nucleotide sequence of SEQ ID NO:4, 6, 7, or 9. In another preferred embodiment, an OAT protein includes at least one of the following domains: a transmembrane domain, a sugar (and other) transporter domain, and/or an ATP/GTP-binding site motif A (P-loop) domain, and has an OAT activity.

As used interchangeably herein, an "OAT activity", "biological activity of OAT" or "functional activity of OAT", refers to an activity exhibited by an OAT protein, polypeptide or nucleic acid molecule (e.g., in an OAT expressing cell or tissue) on an OAT responsive cell or an OAT substrate, as determined in vivo or in vitro, according to standard techniques. In one embodiment, an OAT activity is a direct activity, such as transport of an OAT substrate, e.g., a metabolite of a lipophilic compound such as a sulfate or glucuronide conjugate. As used herein, an "OAT substrate" is a molecule which is transported from one side of a membrane to the other. Exemplary OAT substrates include, but are not limited to, organic anions such as drugs, xenobiotics, and metabolites of lipophilic compounds such as sulfate and glucuronide conjugates. Examples of OAT substrates also include non-transported molecules that are essential for OAT function, such as ATP or GTP. An OAT activity can also be a direct activity such as an association with an OAT target molecule. An OAT target molecule can be a non-OAT molecule or an OAT protein or polypeptide of the present invention. In an exemplary embodiment, an OAT target molecule is an intracellular signaling protein that mediates an OAT-modulated signal transduction pathway. An OAT activity can also be an indirect activity, such as a cellular signaling activity mediated by transport of an OAT substrate or by interaction of the OAT protein with an OAT substrate or target molecule.

In a preferred embodiment, an OAT activity is at least one of the following activities: (i) interaction with an OAT substrate or target molecule; (ii) transport of an OAT substrate across a membrane; (iii) interaction with and/or modulation of a second non-OAT protein; (iv) modulation of cellular signaling and/or gene transcription (e.g., either directly or indirectly); (v) protection of cells and/or tissues from organic anions; and/or (vi) modulation of hormonal responses.

The nucleotide sequence of the isolated human OAT4 cDNA and the predicted amino acid sequence encoded by the OAT4 cDNA are shown in FIGS. 1A–B and in SEQ ID NO:4 and 5, respectively.

The nucleotide sequence of the isolated human OAT5 cDNA and the predicted amino acid sequence encoded by the OAT5 cDNA are shown in FIGS. 6 and 2 and in SEQ ID NO:7 and 8, respectively.

The human OAT4 gene, which is approximately 2206 nucleotides in length, encodes a protein having a molecular weight of approximately 60.5 kD and which is approximately 550 amino acid residues in length. The human OAT5 gene, which is approximately 2634 nucleotides in length, encodes a protein having a molecular weight of approximately 79.6 kD and which is approximately 724 amino acid residues in length.

Various aspects of the invention are described in further detail in the following subsections:

Isolated Nucleic Acid Molecules

One aspect of the invention pertains to isolated nucleic acid molecules that encode OAT proteins or biologically active portions thereof, as well as nucleic acid fragments sufficient for use as hybridization probes to identify OAT-encoding nucleic acid molecules (e.g., OAT mRNA) and fragments for use as PCR primers for the amplification or mutation of OAT nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

The term "isolated nucleic acid molecule" includes nucleic acid molecules which are separated from other nucleic acid molecules which are present in the natural source of the nucleic acid. For example, with regards to genomic DNA, the term "isolated" includes nucleic acid molecules which are separated from the chromosome with which the genomic DNA is naturally associated. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. For example, in various embodiments, the isolated OAT nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material, or culture medium when produced by recombinant techniques, or substantially free of chemical precursors or other chemicals when chemically synthesized.

A nucleic acid molecule of the present invention, e.g., a nucleic acid molecule having the nucleotide sequence of SEQ ID NO:4, 6, 7, or 9, or a portion thereof, can be isolated using standard molecular biology techniques and the sequence information provided herein. Using all or a portion of the nucleic acid sequence of SEQ ID NO:4, 6, 7, or 9, as hybridization probes, OAT nucleic acid molecules can be isolated using standard hybridization and cloning techniques (e.g., as described in Sambrook, J. et al., *Molecular Cloning: A Laboratory Manual 2nd, ed., Cold Spring Harbor Laboratory,* Cold Spring Harbor Laboratory Press, Cold Spring Harbor, N.Y., 1989).

Moreover, a nucleic acid molecule encompassing all or a portion of SEQ ID NO:4, 6, 7, or 9 can be isolated by the polymerase chain reaction (PCR) using synthetic oligonucleotide primers designed based upon the sequence of SEQ ID NO:4, 6, 7, or 9.

A nucleic acid of the invention can be amplified using cDNA, mRNA or alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to OAT nucleotide sequences can be prepared by standard synthetic techniques, e.g., using an automated DNA synthesizer.

In one embodiment, an isolated nucleic acid molecule of the invention comprises the nucleotide sequence shown in SEQ ID NO:4 or 6. This cDNA may comprise sequences encoding the human OAT4 protein (e.g., the "coding region", from nucleotides 372–2021), as well as 5' untranslated sequence (nucleotides 1–371) and 3' untranslated sequences (nucleotides 2022–2206) of SEQ ID NO:4. Alternatively, the nucleic acid molecule can comprise only the coding region of SEQ ID NO:4 (e.g., nucleotides 372–2021, corresponding to SEQ ID NO:6). Accordingly, in another embodiment, an isolated nucleic acid molecule of the invention comprises SEQ ID NO:6 and nucleotides 1–371 of SEQ ID NO:4. In yet another embodiment, the isolated nucleic acid molecule comprises SEQ ID NO:6 and nucleotides 2022–2206 of SEQ ID NO:4. In yet another embodiment, the nucleic acid molecule consists of the nucleotide sequence set forth as SEQ ID NO:4 or SEQ ID NO:6. In still another embodiment, the nucleic acid molecule can comprise the coding region of SEQ ID NO:4 (e.g., nucleotides 372–2021, corresponding to SEQ ID NO:6), as well as a stop codon (e.g., nucleotides 2022–2024 of SEQ ID NO:4). In another embodiment, the nucleic acid molecule comprises nucleotides 1–25 of SEQ ID NO:4 or nucleotides 2186–2206 of SEQ ID NO:4.

In another embodiment, an isolated nucleic acid molecule of the invention comprises the nucleotide sequence shown in SEQ ID NO:7 or 9. This cDNA may comprise sequences encoding the human OAT4 protein (e.g., the "coding region", from nucleotides 104–2275), as well as 5' untranslated sequence (nucleotides 1–103) and 3' untranslated sequences (nucleotides 2276–2634) of SEQ ID NO:7. Alternatively, the nucleic acid molecule can comprise only the coding region of SEQ ID NO:7 (e.g., nucleotides 104–2275, corresponding to SEQ ID NO:9). Accordingly, in another embodiment, an isolated nucleic acid molecule of the invention comprises SEQ ID NO:9 and nucleotides 1–103 of SEQ ID NO:7. In yet another embodiment, the isolated nucleic acid molecule comprises SEQ ID NO:9 and nucleotides 2276–2634 of SEQ ID NO:7. In yet another embodiment, the nucleic acid molecule consists of the nucleotide sequence set forth as SEQ ID NO:7 or SEQ ID NO:9. In still another embodiment, the nucleic acid molecule can comprise the coding region of SEQ ID NO:7 (e.g., nucleotides 104–2275, corresponding to SEQ ID NO:9), as well as a stop codon (e.g., nucleotides 2276–2278 of SEQ ID NO:7). In another embodiment, the nucleic acid molecule comprises nucleotides 1–1305, nucleotides 1622–2634, nucleotides 104–1305, or nucleotides 1622–2275 of SEQ ID NO:7.

In still another embodiment, an isolated nucleic acid molecule of the invention comprises a nucleic acid molecule which is a complement of the nucleotide sequence shown in SEQ ID NO:4, 6, 7, or 9, or a portion of any of these nucleotide sequences. A nucleic acid molecule which is complementary to the nucleotide sequence shown in SEQ ID NO:4, 6, 7, or 9, is one which is sufficiently complementary to the nucleotide sequence shown in SEQ ID NO:4, 6, 7, or 9, such that it can hybridize to the nucleotide sequence shown in SEQ ID NO:4, 6, 7, or 9, thereby forming a stable duplex.

In still another embodiment, an isolated nucleic acid molecule of the present invention comprises a nucleotide sequence which is at least about 50%, 55%, 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more identical to the nucleotide sequence shown in SEQ ID NO:4, 6, 7, or 9 (e.g., to the entire length of the nucleotide sequence), or a portion or complement of any of these nucleotide sequences. In one embodiment, a nucleic acid molecule of the present invention comprises a nucleotide sequence which is at least (or no greater than) 50, 100, 150, 200, 250, 300, 317, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1769, 1800, 1850, 1869, 1900, 1950, 2000, 2050, 2100, 2150, 2200, 2250, 2300, 2350, 2400, 2450, 2500, 2550, 2600 or more nucleotides in length and hybridizes under stringent hybridization conditions to a nucleic acid molecule comprising the nucleotide sequence of SEQ ID NO:4, 6, 7, or 9.

Moreover, the nucleic acid molecule of the invention can comprise only a portion of the nucleic acid sequence of SEQ ID NO:4, 6, 7, or 9, for example, a fragment which can be used as a probe or primer or a fragment encoding a portion of an OAT protein, e.g., a biologically active portion of an OAT protein. The nucleotide sequence determined from the cloning of the OAT gene allows for the generation of probes and primers designed for use in identifying and/or cloning other OAT family members, as well as OAT homologues from other species. The probe/primer (e.g., oligonucleotide) typically comprises substantially purified oligonucleotide. The oligonucleotide typically comprises a region of nucleotide sequence that hybridizes under stringent conditions to at least about 12 or 15, preferably about 20 or 25, more preferably about 30, 35, 40, 45, 50, 55, 60, 65, or 75 consecutive nucleotides of a sense sequence of SEQ ID NO:4, 6, 7, or 9, of an anti-sense sequence of SEQ ID NO:4, 6, 7, or 9, or of a naturally occurring allelic variant or mutant of SEQ ID NO:4, 6, 7, or 9.

Exemplary probes or primers are at least (or no greater than) 12, 15, 20, 25, 30, 35, 40, 45, 50, 55, 60, 65, 70, 75 or more nucleotides in length and/or comprise consecutive nucleotides of an isolated nucleic acid molecule described herein. Also included within the scope of the present invention are probes or primers comprising contiguous or consecutive nucleotides of an isolated nucleic acid molecule described herein, but for the difference of 1, 2, 3, 4, 5, 6, 7, 8, 9 or 10 bases within the probe or primer sequence. Probes based on the OAT nucleotide sequences can be used to detect (e.g., specifically detect) transcripts or genomic sequences encoding the same or homologous proteins. In preferred embodiments, the probe further comprises a label group attached thereto, e.g., the label group can be a radioisotope, a fluorescent compound, an enzyme, or an enzyme co-factor. In another embodiment a set of primers is provided, e.g., primers suitable for use in a PCR, which can be used to amplify a selected region of an OAT sequence, e.g., a domain, region, site or other sequence described herein. The primers should be at least 5, 10, or 50 base pairs in length and less than 100, or less than 200, base pairs in length. The primers should be identical, or differ by no greater than 1, 2, 3, 4, 5, 6, 7, 8, 9 or 10 bases when compared to a sequence disclosed herein or to the sequence of a naturally occurring variant. Such probes can be used as a part of a diagnostic test kit for identifying cells or tissue which misexpress an OAT protein, such as by measuring a level of an OAT-encoding nucleic acid in a sample of cells from a subject, e.g., detecting OAT mRNA levels or determining whether a genomic OAT gene has been mutated or deleted.

A nucleic acid fragment encoding a "biologically active portion of an OAT protein" can be prepared by isolating a portion of the nucleotide sequence of SEQ ID NO:4, 6, 7, or 9, which encodes a polypeptide having an OAT biological activity (the biological activities of the OAT proteins are described herein), expressing the encoded portion of the OAT protein (e.g., by recombinant expression in vitro) and assessing the activity of the encoded portion of the OAT protein. In an exemplary embodiment, the nucleic acid molecule is at least 50, 100, 150, 200, 250, 300, 317, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1769, 1800, 1850, 1869, 1900, 1950, 2000, 2050, 2100, 2150, 2200, 2250, 2300, 2350, 2400, 2450, 2500, 2550, 2600 or more nucleotides in length and encodes a protein having an OAT activity (as described herein).

The invention further encompasses nucleic acid molecules that differ from the nucleotide sequence shown in SEQ ID NO:4, 6, 7, or 9, due to degeneracy of the genetic code and thus encode the same OAT proteins as those encoded by the nucleotide sequence shown in SEQ ID NO:4, 6, 7, or 9. In another embodiment, an isolated nucleic acid molecule of the invention has a nucleotide sequence encoding a protein having an amino acid sequence which differs by at least 1, but no greater than 5, 10, 20, 50 or 100 amino acid residues from the amino acid sequence shown in SEQ ID NO:5 or 8. In yet another embodiment, the nucleic acid molecule encodes the amino acid sequence of human OAT4 or OAT5. If an alignment is needed for this comparison, the sequences should be aligned for maximum homology.

Nucleic acid variants can be naturally occurring, such as allelic variants (same locus), homologues (different locus), and orthologues (different organism) or can be non naturally occurring. Non-naturally occurring variants can be made by mutagenesis techniques, including those applied to polynucleotides, cells, or organisms. The variants can contain nucleotide substitutions, deletions, inversions and insertions. Variation can occur in either or both the coding and non-coding regions. The variations can produce both conservative and non-conservative amino acid substitutions (as compared in the encoded product).

Allelic variants result, for example, from DNA sequence polymorphisms within a population (e.g., the human population) that lead to changes in the amino acid sequences of the OAT proteins. Such genetic polymorphism in the OAT genes may exist among individuals within a population due to natural allelic variation. As used herein, the terms "gene" and "recombinant gene" refer to nucleic acid molecules which include an open reading frame encoding an OAT protein, preferably a mammalian OAT protein, and can further include non-coding regulatory sequences, and introns.

Accordingly, in one embodiment, the invention features isolated nucleic acid molecules which encode a naturally occurring allelic variant of a polypeptide comprising the amino acid sequence of SEQ ID NO:5 or 8, wherein the nucleic acid molecule hybridizes to a complement of a nucleic acid molecule comprising SEQ ID NO:4, 6, 7, or 9, for example, under stringent hybridization conditions.

Allelic variants of human OAT include both functional and non-functional OAT proteins. Functional allelic variants are naturally occurring amino acid sequence variants of the OAT protein that maintain the ability to bind an OAT substrate or target molecule, transport an OAT substrate across a membrane, protect cells and/or tissues from organic anions, modulate inter- or intra-cellular signaling, and/or modulate hormone responses. Functional allelic variants will typically contain only conservative substitution of one or more amino acids of SEQ ID NO:5 or 8, or substitution, deletion or insertion of non-critical residues in non-critical regions of the protein.

Non-functional allelic variants are naturally occurring amino acid sequence variants of the OAT proteins that, for example, do not have the ability to bind an OAT substrate or target molecule, transport an OAT substrate, protect cells and/or tissues from organic anions, modulate inter- or intra-cellular signaling, and/or modulate hormone responses. Non-functional allelic variants will typically contain a non-conservative substitution, a deletion, or insertion, or premature truncation of the amino acid sequence of SEQ ID NO:5 or 8, or a substitution, insertion, or deletion in critical residues or critical regions of the protein.

The present invention further provides non-human orthologues (e.g., non-human orthologues of the human OAT4 or OAT5 proteins). Orthologues of the human OAT proteins are proteins that are isolated from non-human organisms and possess the same OAT substrate-transporting mechanisms, substrate or target molecule binding mechanisms, mechanisms of protecting cells and/or tissues from organic anions, and/or inter- or intra-cellular signaling or hormonal modulating mechanisms of the human OAT proteins. Orthologues of the human OAT proteins can readily be identified as comprising an amino acid sequence that is substantially homologous to SEQ ID NO:5 or 8.

Moreover, nucleic acid molecules encoding other OAT family members and, thus, which have a nucleotide sequence which differs from the OAT sequences of SEQ ID NO:4, 6, 7, or 9 are intended to be within the scope of the invention. For example, another OAT cDNA can be identified based on the nucleotide sequence of human OAT4 or OAT5. Moreover, nucleic acid molecules encoding OAT proteins from different species, and which, thus, have a nucleotide sequence which differs from the OAT sequences of SEQ ID NO:4, 6, 7, or 9 are intended to be within the scope of the invention. For example, a mouse or monkey OAT cDNA can be identified based on the nucleotide sequence of human OAT, e.g., OAT4 or OAT5.

Nucleic acid molecules corresponding to natural allelic variants and homologues of the OAT cDNAs of the invention can be isolated based on their homology to the OAT nucleic acids disclosed herein using the cDNAs disclosed herein, or a portion thereof, as a hybridization probe according to standard hybridization techniques under stringent hybridization conditions. Nucleic acid molecules corresponding to natural allelic variants and homologues of the OAT cDNAs of the invention can further be isolated by mapping to the same chromosome or locus as the OAT gene.

Orthologues, homologues and allelic variants can be identified using methods known in the art (e.g., by hybridization to an isolated nucleic acid molecule of the present invention, for example, under stringent hybridization conditions). In one embodiment, an isolated nucleic acid molecule of the invention is at least 15, 20, 25, 30 or more nucleotides in length and hybridizes under stringent conditions to the nucleic acid molecule comprising the nucleotide sequence of SEQ ID NO:4, 6, 7, or 9. In other embodiment, the nucleic acid is at least 50, 100, 150, 200, 250, 300, 317, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1769, 1800, 1850, 1869, 1900, 1950, 2000, 2050, 2100, 2150, 2200, 2250, 2300, 2350, 2400, 2450, 2500, 2550, 2600 or more nucleotides in length.

As used herein, the term "hybridizes under stringent conditions" is intended to describe conditions for hybridization and washing under which nucleotide sequences that are significantly identical or homologous to each other remain hybridized to each other. Preferably, the conditions are such that sequences at least about 70%, more preferably at least about 80%, even more preferably at least about 85% or 90% identical to each other remain hybridized to each other. Such stringent conditions are known to those skilled in the art and can be found in *Current Protocols in Molecular Biology*, Ausubel et al., eds., John Wiley & Sons, Inc. (1995), sections 2, 4 and 6. Additional stringent conditions can be found in *Molecular Cloning: A Laboratory Manual*, Sambrook et al., Cold Spring Harbor Press, Cold Spring Harbor, N.Y. (1989), chapters 7, 9 and 11. A preferred, non-limiting example of stringent hybridization conditions includes hybridization in 4× or 6× sodium chloride/sodium citrate (SSC), at about 65–70° C. (or hybridization in 4×SSC plus 50% formamide at about 42–50° C.) followed by one or more washes in 1×SSC, at about 65–70° C. A further preferred, non-limiting example of stringent hybridization conditions includes hybridization at 6×SSC at 45° C., followed by one or more washes in 0.2×SSC, 0.1% SDS at 65° C. A preferred, non-limiting example of highly stringent hybridization conditions includes hybridization in 1×SSC, at about 65–70° C. (or hybridization in 1×SSC plus 50% formamide at about 42–50° C.) followed by one or more washes in 0.3×SSC, at about 65–70° C. A preferred, non-limiting example of reduced stringency hybridization conditions includes hybridization in 4× or 6×SSC, at about 50–60° C. (or alternatively hybridization in 6×SSC plus 50% formamide at about 4045° C.) followed by one or more washes in 2×SSC, at about 50–60° C. Ranges intermediate to the above-recited values, e.g., at 65–70° C. or at 42–50° C. are also intended to be encompassed by the present invention. SSPE (1×SSPE is 0.15M NaCl, 10 mM NaH$_2$PO$_4$, and 1.25 mM EDTA, pH 7.4) can be substituted for SSC (1×SSC is 0.15M NaCl and 15 mM sodium citrate) in the hybridization and wash buffers; washes are performed for 15 minutes each after hybridization is complete. The hybridization temperature for hybrids anticipated to be less than 50 base pairs in length should be 5–10° C. less than the melting temperature (T$_m$) of the hybrid, where T$_m$ is determined according to the following equations. For hybrids less than 18 base pairs in length, T$_m$(° C.)=2(# of A+T bases)+4(# of G+C bases). For hybrids between 18 and 49 base pairs in length, T$_m$(° C.)=81.5+16.6(log$_{10}$[Na$^+$])+0.41(% G+C)−(600/N), where N is the number of bases in the hybrid, and [Na$^+$] is the concentration of sodium ions in the hybridization buffer ([Na$^+$] for 1×SSC=0.165 M). It will also be recognized by the skilled practitioner that additional reagents may be added to hybridization and/or wash buffers to decrease non-specific hybridization of nucleic acid molecules to membranes, for example, nitrocellulose or nylon membranes, including but not limited to blocking agents (e.g., BSA or salmon or herring sperm carrier DNA), detergents (e.g., SDS), chelating agents (e.g., EDTA), Ficoll, PVP and the like. When using nylon membranes, in particular, an additional preferred, non-limiting example of stringent hybridization conditions is hybridization in 0.25–0.5M NaH$_2$PO$_4$, 7% SDS at about 65° C., followed by one or more washes at 0.02M NaH$_2$PO$_4$, 1% SDS at 65° C., see e.g., Church and Gilbert (1984) *Proc. Natl. Acad. Sci. USA* 81:1991–1995, (or alternatively 0.2×SSC, 1% SDS).

Preferably, an isolated nucleic acid molecule of the invention that hybridizes under stringent conditions to the sequence of SEQ ID NO:4, 6, 7, or 9 corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In addition to naturally-occurring allelic variants of the OAT sequences that may exist in the population, the skilled artisan will further appreciate that changes can be introduced by mutation into the nucleotide sequences of SEQ ID NO:4, 6, 7, or 9, thereby leading to changes in the amino acid sequence of the encoded OAT proteins, without altering the functional ability of the OAT proteins. For example, nucleotide substitutions leading to amino acid substitutions at "non-essential" amino acid residues can be made in the sequence of SEQ ID NO:4, 6, 7, or 9. A "non-essential" amino acid residue is a residue that can be altered from the wild-type sequence of OAT (e.g., the sequence of SEQ ID NO:5 or 8) without altering the biological activity, whereas an "essential" amino acid residue is required for biological activity. For example, amino acid residues that are conserved among the OAT proteins of the present invention, e.g., those present in a transmembrane domain, are predicted to be particularly unamenable to alteration. Furthermore, additional amino acid residues that are conserved between the OAT proteins of the present invention and other members of the organic anion transporter family are not likely to be amenable to alteration.

Accordingly, another aspect of the invention pertains to nucleic acid molecules encoding OAT proteins that contain changes in amino acid residues that are not essential for activity. Such OAT proteins differ in amino acid sequence from SEQ ID NO:5 or 8, yet retain biological activity. In one embodiment, the isolated nucleic acid molecule comprises a nucleotide sequence encoding a protein, wherein the protein comprises an amino acid sequence at least about 50%, 55%, 60%, 65%, 70%, 75%, 80%, 85%, 90%, 91%, 92%, 93%, 94%, 95%, 96%, 97%, 98% 99%, 99.1%, 99.2%, 99.3%, 99.4%, 99.5%, 99.6%, 99.7%, 99.8%, 99.9% or more identical to SEQ ID NO:5 or 8, e.g., to the entire length of SEQ ID NO:5 or 8.

An isolated nucleic acid molecule encoding an OAT protein homologous to the protein of SEQ ID NO:5 or 8 can be created by introducing one or more nucleotide substitutions, additions or deletions into the nucleotide sequence of SEQ ID NO:4, 6, 7, or 9, such that one or more amino acid substitutions, additions or deletions are introduced into the encoded protein. Mutations can be introduced into SEQ ID NO:4, 6, 7, or 9 by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid-residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, a predicted nonessential amino acid residue in an OAT protein is preferably replaced with another amino acid residue from the same side chain family. Alternatively, in another embodiment, mutations can be introduced randomly along all or part of an OAT coding sequence, such as by saturation mutagenesis, and the resultant mutants can be screened for OAT biological activity to identify mutants that retain activity. Following mutagenesis of SEQ ID NO:4, 6, 7, or 9, the encoded protein can be expressed recombinantly and the activity of the protein can be determined.

In a preferred embodiment, a mutant OAT protein can be assayed for the ability to (i) interact with an OAT substrate or target molecule; (ii) transport an OAT substrate across a membrane; (iii) interact with and/or modulation of a second non-OAT protein; (iv) modulate cellular signaling and/or gene transcription (e.g., either directly or indirectly); (v) protect cells and/or tissues from organic anions; and/or (vi) modulate hormonal responses.

In addition to the nucleic acid molecules encoding OAT proteins described above, another aspect of the invention pertains to isolated nucleic acid molecules which are antisense thereto. In an exemplary embodiment, the invention provides an isolated nucleic acid molecule which is antisense to an OAT nucleic acid molecule (e.g., is antisense to the coding strand of an OAT nucleic acid molecule). An "antisense" nucleic acid comprises a nucleotide sequence which is complementary to a "sense" nucleic acid encoding a protein, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire OAT coding strand, or to only a portion thereof. In one embodiment, an antisense nucleic acid molecule is antisense to "coding region sequences" of the coding strand of a nucleotide sequence encoding OAT. The term "coding region sequences" refers to the region of the nucleotide sequence comprising codons which are translated into amino acid residues (e.g., the coding region sequences of human OAT4, corresponding to SEQ ID NO:6, or the coding region sequences of human OAT5, corresponding to SEQ ID NO:9). In another embodiment, the antisense nucleic acid molecule is antisense to a "noncoding region" of the coding strand of a nucleotide sequence encoding human OAT4. The term "noncoding region" refers to 5' and/or 3' sequences which flank the coding region sequences that are not translated into amino acids (also referred to as 5' and 3' untranslated regions).

Given the coding strand sequences encoding OAT proteins disclosed herein (e.g., SEQ ID NO:6 or 9), antisense nucleic acids of the invention can be designed according to the rules of Watson and Crick base pairing. The antisense nucleic acid molecule can be complementary to coding region sequences of the OAT mRNA, but more preferably is an oligonucleotide which is antisense to only a portion of the OAT mRNA. An antisense oligonucleotide can be, for example, about 5, 10, 15, 20, 25, 30, 35, 40, 45, 50, 55, 60, 65, 70, 75, 80, or more nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xantine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding an OAT protein to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. An example of a route of administration of antisense nucleic acid molecules of the invention include direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids Res.* 15:6625–6641). The antisense nucleic acid molecule can also comprise a 2'-o-methylribonucleotide (Inoue et al. (1987) *Nucleic Acids Res.* 15:6131–6148) or a chimeric RNA-DNA analogue (Inoue et al. (1987) *FEBS Lett.* 215:327–330).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haseloff and Gerlach (1988) *Nature* 334:585–591)) can be used to catalytically cleave OAT mRNA transcripts to thereby inhibit translation of OAT mRNA. A ribozyme having specificity for an OAT-encoding nucleic acid can be designed based upon the nucleotide sequence of an OAT cDNA disclosed herein (i.e., SEQ ID NO:4, 6, 7, or 9). For example, a derivative of a Tetrahymena L-19 IVS RNA can be constructed in which the nucleotide sequence of the active site is complementary to the nucleotide sequence to be cleaved in an OAT-encoding mRNA. See, e.g., Cech et al., U.S. Pat. No. 4,987,071; and Cech et al., U.S. Pat. No. 5,116,742. Alternatively, OAT mRNA can be used to select a catalytic RNA having a specific ribonuclease activity from a pool of RNA molecules. See, e.g., Bartel, D. and Szostak, J. W. (1993) *Science* 261:1411–1418.

Alternatively, OAT gene expression can be inhibited by targeting nucleotide sequences complementary to the regulatory region of the OAT (e.g., the OAT promoter and/or enhancers; e.g., nucleotides 1–371 of SEQ ID NO:4) to form triple helical structures that prevent transcription of the OAT gene in target cells. See generally, Helene, C. (1991) *Anticancer Drug Des.* 6(6):569–84; Helene, C. et al. (1992) *Ann. N.Y. Acad. Sci.* 660:27–36; and Maher, L. J. (1992) *Bioessays* 14(12):807–15.

In yet another embodiment, the OAT nucleic acid molecules of the present invention can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acids (see Hyrup, B. and Nielsen, P. E. (1996) *Bioorg. Med. Chem.* 4(1):5–23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup and Nielsen (1996) supra; Perry-O'Keefe et al. (1996) *Proc. Natl. Acad. Sci. USA* 93:14670–675.

PNAs of OAT nucleic acid molecules can be used in therapeutic and diagnostic applications. For example, PNAs can be used as antisense or antigene agents for sequence-specific modulation of gene expression by, for example, inducing transcription or translation arrest or inhibiting replication. PNAs of OAT nucleic acid molecules can also be used in the analysis of single base pair mutations in a gene (e.g., by PNA-directed PCR clamping); as 'artificial restriction enzymes' when used in combination with other enzymes (e.g., S1 nucleases (Hyrup and Nielsen (1996) supra)); or as probes or primers for DNA sequencing or hybridization (Hyrup and Nielsen (1996) supra; Perry-O'Keefe et al. (1996) supra).

In another embodiment, PNAs of OAT can be modified (e.g., to enhance their stability or cellular uptake), by attaching lipophilic or other helper groups to PNA, by the formation of PNA-DNA chimeras, or by the use of liposomes or other techniques of drug delivery known in the art. For example, PNA-DNA chimeras of OAT nucleic acid molecules can be generated which may combine the advantageous properties of PNA and DNA. Such chimeras allow DNA recognition enzymes (e.g., RNase H and DNA polymerases) to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup and Nielsen (1996) supra). The synthesis of PNA-DNA chimeras can be performed as described in Hyrup and Nielsen (1996) supra and Finn, P. J. et al. (1996) *Nucleic Acids Res.* 24 (17):3357–63. For example, a DNA chain can be synthesized on a solid support using standard phosphoramidite coupling chemistry and modified nucleoside analogs, e.g., 5'-(4-methoxytrityl)amino-5'-deoxy-thymidine phosphoramidite, can be used as a between the PNA and the 5' end of DNA (Mag, M. et al. (1989) *Nucleic Acids Res.* 17:5973–88). PNA monomers are then coupled in a stepwise manner to produce a chimeric molecule with a 5' PNA segment and a 3' DNA segment (Finn, P. J. et al. (1996) supra). Alternatively, chimeric molecules can be synthesized with a 5' DNA segment and a 3' PNA segment (Peterser, K. H. et al. (1975) *Bioorganic Med. Chem. Lett.* 5:1119–11124).

In other embodiments, the oligonucleotide may include other appended groups such as peptides (e.g., for targeting host cell receptors in vivo), or agents facilitating transport across the cell membrane (see, e.g., Letsinger et al. (1989) *Proc. Natl. Acad. Sci. USA* 86:6553–6556; Lemaitre et al. (1987) *Proc. Natl. Acad. Sci. USA* 84:648–652; PCT Publication No. WO 88/09810) or the blood-brain barrier (see, e.g., PCT Publication No. WO 89/10134). In addition, oligonucleotides can be modified with hybridization-triggered cleavage agents (See, e.g., Krol et al. (1988) *Bio-Techniques* 6:958–976) or intercalating agents (See, e.g., Zon (1988) *Pharm. Res.* 5:539–549). To this end, the oligonucleotide may be conjugated to another molecule (e.g., a peptide, hybridization triggered cross-linking agent, transport agent, or hybridization-triggered cleavage agent).

Isolated OAT Proteins and Anti-OAT Antibodies

One aspect of the invention pertains to isolated or recombinant OAT proteins and polypeptides, and biologically active portions thereof, as well as polypeptide fragments suitable for use as immunogens to raise anti-OAT antibodies. In one embodiment, native OAT proteins can be isolated from cells or tissue sources by an appropriate purification scheme using standard protein purification techniques. In another embodiment, OAT proteins are produced by recombinant DNA techniques. Alternative to recombinant expression, an OAT protein or polypeptide can be synthesized chemically using standard peptide synthesis techniques.

An "isolated" or "purified" protein or biologically active portion thereof is substantially free of cellular material or other contaminating proteins from the cell or tissue source from which the OAT protein is derived, or substantially free from chemical precursors or other chemicals when chemically synthesized. The language "substantially free of cellular material" includes preparations of OAT protein in which the protein is separated from cellular components of the cells from which it is isolated or recombinantly produced. In one embodiment, the language "substantially free of cellular material" includes preparations of OAT protein having less than about 30% (by dry weight) of non-OAT protein (also referred to herein as a "contaminating protein"), more preferably less than about 20% of non-OAT protein, still more preferably less than about 10% of non-OAT protein, and most preferably less than about 5% non-OAT protein. When the OAT protein or biologically active portion thereof is recombinantly produced, it is also preferably substantially free of culture medium, i.e., culture medium represents less than about 20%, more preferably less than about 10%, and most preferably less than about 5% of the volume of the protein preparation.

The language "substantially free of chemical precursors or other chemicals" includes preparations of OAT protein in which the protein is separated from chemical precursors or other chemicals which are involved in the synthesis of the protein. In one embodiment, the language "substantially free of chemical precursors or other chemicals" includes preparations of OAT protein having less than about 30% (by dry weight) of chemical precursors or non-OAT chemicals, more preferably less than about 20% chemical precursors or non-OAT chemicals, still more preferably less than about 10% chemical precursors or non-OAT chemicals, and most preferably less than about 5% chemical precursors or non-OAT chemicals.

As used herein, a "biologically active portion" of an OAT protein includes a fragment of an OAT protein which participates in an interaction between an OAT molecule and a non-OAT molecule (e.g., an OAT substrate or target molecule). Biologically active portions of an OAT protein include peptides comprising amino acid sequences sufficiently homologous to or derived from the OAT amino acid sequences, e.g., the amino acid sequences shown in SEQ ID NO:5 or 8, which include sufficient amino acid residues to exhibit at least one activity of an OAT protein. Typically, biologically active portions comprise a domain or motif with at least one activity of the OAT protein, e.g., OAT substrate transporting activity, OAT substrate or target molecule binding activity, intra- or inter-cellular signal modulating activity, gene expression modulating activity, hormonal response modulating activity, and/or the ability to protect cells and/or tissues from organic anions. A biologically active portion of an OAT protein can be a polypeptide which is, for example, 10, 25, 50, 75, 100, 125, 150, 175, 200, 250, 300, 350, 400, 450, 500, 550, 600, 650, 700 or more amino acids in length. Biologically active portions of an OAT protein can be used as targets for developing agents which modulate an OAT mediated activity, e.g., OAT substrate transport, OAT substrate or target molecule binding, intra- or inter-cellular signaling, cellular gene expression, hormonal responses, and/or protection of cells and/or tissues from organic anions.

In one embodiment, a biologically active portion of an OAT protein comprises at least one transmembrane domain. Moreover, other biologically active portions, in which other regions of the protein are deleted, can be prepared by recombinant techniques and evaluated for one or more of the functional activities of a native OAT protein.

Another aspect of the invention features fragments of the protein having the amino acid sequence of SEQ ID NO:5 or 8, for example, for use as immunogens. In one embodiment, a fragment comprises at least 8 amino acids (e.g., contiguous or consecutive amino acids) of the amino acid sequence of SEQ ID NO:5 or 8. In another embodiment, a fragment comprises at least 10, 15, 20, 25, 30, 35, 40, 45, 50 or more amino acids (e.g., contiguous or consecutive amino acids) of the amino acid sequence of SEQ ID NO:5 or 8.

In a preferred embodiment, an OAT protein has an amino acid sequence shown in SEQ ID NO:5 or 8. In other embodiments, the OAT protein is substantially identical to SEQ ID NO:5 or 8, and retains the functional activity of the protein of SEQ ID NO:5 or 8, yet differs in amino acid sequence due to natural allelic variation or mutagenesis, as described in detail in subsection I above. In another embodiment, the OAT protein is a protein which comprises an amino acid sequence at least about 50%, 55%, 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more identical to SEQ ID NO:5 or 8.

In another embodiment, the invention features an OAT protein which is encoded by a nucleic acid molecule consisting of a nucleotide sequence at least about 50%, 55%, 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more identical to a nucleotide sequence of SEQ ID NO:4, 6, 7, or 9, or a complement thereof. This invention further features an OAT protein which is encoded by a nucleic acid molecule consisting of a nucleotide sequence which hybridizes under stringent hybridization conditions to a complement of a nucleic acid molecule comprising the nucleotide sequence of SEQ ID NO:4, 6, 7, or 9, or a complement thereof.

To determine the percent identity of two amino acid sequences or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, or 90% of the length of the reference sequence (e.g., when aligning a second sequence to the OAT amino acid sequence of SEQ ID NO:5 having 550 amino acid residues, at least 165, preferably at least 220, more preferably at least 275, even more preferably at least 330, and even more preferably at least 385, 440 or 495 amino acid residues are aligned; when aligning a second sequence to the OAT amino acid sequence of SEQ ID NO:8 having 724 amino acid residues, at least 217, preferably at least 290, more preferably at least 362, even more preferably at least 434, and even more preferably at least 507, 579 or 652 amino acid residues are aligned). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch (*J. Mol. Biol.* (48):444–453 (1970)) algorithm which has been incorporated into the GAP program in the GCG software package (available online through the Genetics Computer Group), using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (available online through the Genetics Computer Group), using a NWSgapdna.CMP matrix and a gap weight of 40, 50, 60, 70, or 80 and a length weight of 1, 2, 3, 4, 5, or 6. A preferred, non-limiting example of parameters to be used in conjunction with the GAP program include a Blosum 62 scoring matrix with a gap penalty of 12, a gap extend penalty of 4, and a frameshift gap penalty of 5.

In another embodiment, the percent identity between two amino acid or nucleotide sequences is determined using the algorithm of Meyers and Miller (*Comput. Appl. Biosci.* 4:11–17 (1988)) which has been incorporated into the ALIGN program (version 2.0 or version 2.0U), using a PAM 120 weight residue table, a gap length penalty of 12 and a gap penalty of 4.

The nucleic acid and protein sequences of the present invention can further be used as a "query sequence" to perform a search against public databases to, for example, identify other family members or related sequences. Such searches can be performed using the NBLAST and XBLAST programs (version 2.0) of Altschul et al. (1990) *J. Mol. Biol.* 215:403–10. BLAST nucleotide searches can be performed with the NBLAST program, score=100, wordlength=12 to obtain nucleotide sequences homologous to OAT nucleic acid molecules of the invention. BLAST protein searches can be performed with the XBLAST program, score=50, wordlength=3 to obtain amino acid sequences homologous to OAT protein molecules of the invention. To obtain gapped alignments for comparison purposes, Gapped BLAST can be utilized as described in Altschul et al. (1997) *Nucleic Acids Res.* 25(17):3389–3402. When utilizing BLAST and Gapped BLAST programs, the default parameters of the respective programs (e.g., XBLAST and NBLAST) can be used. See the internet website for the National Center for Biotechnology Information.

The invention also provides OAT chimeric or fusion proteins. As used herein, an OAT "chimeric protein" or "fusion protein" comprises an OAT polypeptide operatively linked to a non-OAT polypeptide. AN "OAT polypeptide" refers to a polypeptide having an amino acid sequence corresponding to an OAT protein, whereas a "non-OAT polypeptide" refers to a polypeptide having an amino acid sequence corresponding to a protein which is not substantially homologous to the OAT protein, e.g., a protein which is different from the OAT protein and which is derived from the same or a different organism. Within an OAT fusion protein the OAT polypeptide can correspond to all or a portion of an OAT protein. In a preferred embodiment, an OAT fusion protein comprises at least one biologically active portion of an OAT protein. In another preferred embodiment, an OAT fusion protein comprises at least two biologically active portions of an OAT protein. Within the fusion protein, the term "operatively linked" is intended to indicate that the OAT polypeptide and the non-OAT polypeptide are fused in-frame to each other. The non-OAT polypeptide can be fused to the N-terminus or C-terminus of the OAT polypeptide.

For example, in one embodiment, the fusion protein is a GST-OAT fusion protein in which the OAT sequences are fused to the C-terminus of the GST sequences. Such fusion proteins can facilitate the purification of recombinant OAT. In another embodiment, the fusion protein is an OAT protein containing a heterologous signal sequence at its N-terminus. In certain host cells (e.g., mammalian host cells), expression and/or secretion of OAT can be increased through use of a heterologous signal sequence.

The OAT fusion proteins of the invention can be incorporated into pharmaceutical compositions and administered to a subject in vivo. The OAT fusion proteins can be used to affect the bioavailability of an OAT substrate. Use of OAT fusion proteins may be useful therapeutically for the treatment of disorders caused by, for example, (i) aberrant modification or mutation of a gene encoding an OAT protein; (ii) mis-regulation of the OAT gene; and (iii) aberrant post-translational modification of an OAT protein.

Moreover, the OAT-fusion proteins of the invention can be used as immunogens to produce anti-OAT antibodies in a subject, to purify OAT ligands, and in screening assays to identify molecules which inhibit the interaction of OAT with an OAT substrate or target molecule or the transport of an OAT substrate.

Preferably, an OAT chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). AN OAT-encoding nucleic acid can be cloned into such an expression vector such that the fusion moiety is linked in-frame to the OAT protein.

The present invention also pertains to variants of the OAT proteins which function as either OAT agonists (mimetics) or as OAT antagonists. Variants of the OAT proteins can be generated by mutagenesis, e.g., discrete point mutation or truncation of an OAT protein. An agonist of the OAT proteins can retain substantially the same, or a subset, of the biological activities of the naturally occurring form of an OAT protein. An antagonist of an OAT protein can inhibit one or more of the activities of the naturally occurring form of the OAT protein by, for example, competitively modulating an OAT-mediated activity of an OAT protein. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the OAT protein.

In one embodiment, variants of an OAT protein which function as either OAT agonists (mimetics) or as OAT antagonists can be identified by screening combinatorial libraries of mutants, e.g., truncation mutants, of an OAT protein for OAT protein agonist or antagonist activity. In one embodiment, a variegated library of OAT variants is generated by combinatorial mutagenesis at the nucleic acid level and is encoded by a variegated gene library. A variegated library of OAT variants can be produced by, for example, enzymatically ligating a mixture of synthetic oligonucleotides into gene sequences such that a degenerate set of potential OAT sequences is expressible as individual polypeptides, or alternatively, as a set of larger fusion proteins (e.g., for phage display) containing the set of OAT sequences therein. There are a variety of methods which can be used to produce libraries of potential OAT variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential OAT sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477.

In addition, libraries of fragments of an OAT protein coding sequence can be used to generate a variegated population of OAT fragments for screening and subsequent selection of variants of an OAT protein. In one embodiment, a library of coding sequence fragments can be generated by treating a double stranded PCR fragment of an OAT coding sequence with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the OAT protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of OAT proteins. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique which enhances the frequency of functional mutants in the libraries, can be used in combination with the screening assays to identify OAT variants (Arkin and Youvan (1992) *Proc. Natl. Acad. Sci. USA* 89:7811–7815; Delagrave et al. (1993) *Protein Eng.* 6(3):327–331).

In one embodiment, cell based assays can be exploited to analyze a variegated OAT library. For example, a library of expression vectors can be transfected into a cell line, e.g., a liver cell line, which ordinarily responds to OAT in a particular OAT substrate-dependent manner. The transfected cells are then contacted with an OAT substrate and the effect of the expression of the mutant on signaling by the OAT substrate can be detected, e.g., by measuring levels of OAT substrate transported into or out of the cells, by measuring gene transcription, by measuring cellular proliferation, and/ or by measuring activity of intracellular signaling pathways. Plasmid DNA can then be recovered from the cells which score for inhibition, or alternatively, potentiation of signaling by the OAT substrate, and the individual clones further characterized.

An isolated OAT protein, or a portion or fragment thereof, can be used as an immunogen to generate antibodies that bind OAT using standard techniques for polyclonal and monoclonal antibody preparation. A full-length OAT protein can be used or, alternatively, the invention provides antigenic peptide fragments of OAT for use as immunogens. The antigenic peptide of OAT comprises at least 8 amino acid residues of the amino acid sequence shown in SEQ ID NO:5 or 8 and encompasses an epitope of OAT such that an antibody raised against the peptide forms a specific immune complex with OAT. Preferably, the antigenic peptide comprises at least 10 amino acid residues, more preferably at least 15 amino acid residues, even more preferably at least 20 amino acid residues, and most preferably at least 30 amino acid residues.

Figure 8:
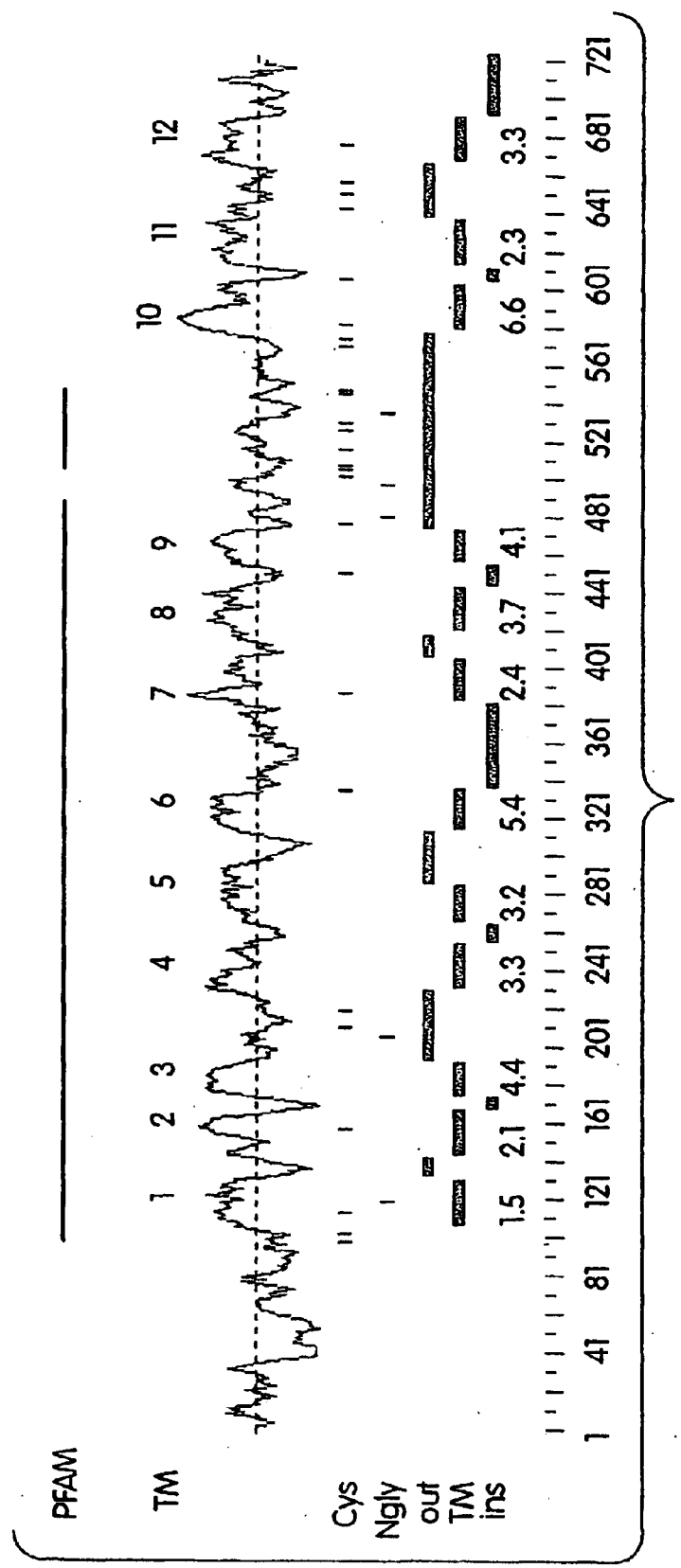
FIG. 8 depicts a structural, hydrophobicity, and antigenicity analysis of the human OAT5 protein. The locations of the 12 transmembrane domains are indicated (TM 1, 2, 3, etc.).

Preferred epitopes encompassed by the antigenic peptide are regions of OAT that are located on the surface of the protein, e.g., hydrophilic regions, as well as regions with high antigenicity (see, for example, FIGS. 7 and 8).

An OAT immunogen typically is used to prepare antibodies by immunizing a suitable subject (e.g., rabbit, goat, mouse, or other mammal) with the immunogen. An appropriate immunogenic preparation can contain, for example, recombinantly expressed OAT protein or a chemically-synthesized OAT polypeptide. The preparation can further include an adjuvant, such as Freund's complete or incomplete adjuvant, or similar immunostimulatory agent. Immunization of a suitable subject with an immunogenic OAT preparation induces a polyclonal anti-OAT antibody response.

Accordingly, another aspect of the invention pertains to anti-OAT antibodies. The term "antibody" as used herein refers to immunoglobulin molecules and immunologically active portions of immunoglobulin molecules, i.e., molecules that contain an antigen binding site which specifically binds (immunoreacts with) an antigen, such as OAT. Examples of immunologically active portions of immunoglobulin molecules include F(ab) and F(ab')$_2$ fragments which can be generated by treating the antibody with an enzyme such as pepsin. The invention provides polyclonal and monoclonal antibodies that bind OAT. The term "monoclonal antibody" or "monoclonal antibody composition", as used herein, refers to a population of antibody molecules that contain only one species of an antigen binding site capable of immunoreacting with a particular epitope of OAT. A monoclonal antibody composition thus typically displays a single binding affinity for a particular OAT protein with which it immunoreacts.

Polyclonal anti-OAT antibodies can be prepared as described above by immunizing a suitable subject with an OAT immunogen. The anti-OAT antibody titer in the immunized subject can be monitored over time by standard techniques, such as with an enzyme linked immunosorbent assay (ELISA) using immobilized OAT. If desired, the antibody molecules directed against OAT can be isolated from the mammal (e.g., from the blood) and further purified by well known techniques, such as protein A chromatography to obtain the IgG fraction. At an appropriate time after immunization, e.g., when the anti-OAT antibody titers are highest, antibody-producing cells can be obtained from the subject and used to prepare monoclonal antibodies by standard techniques, such as the hybridoma technique originally described by Kohler and Milstein (1975) *Nature* 256:495497 (see also Brown et al. (1981) *J. Immunol.* 127:539–46; Brown et al. (1980) *J. Biol. Chem.* 255:4980–83; Yeh et al. (1976) *Proc. Natl. Acad. Sci. USA* 76:2927–31; and Yeh et al. (1982) *Int. J. Cancer* 29:269–75), the more recent human B cell hybridoma technique (Kozbor et al. (1983) *Immunol. Today* 4:72), the EBV-hybridoma technique (Cole et al. (1985) *Monoclonal Antibodies and Cancer Therapy*, Alan R. Liss, Inc., pp. 77–96) or trioma techniques. The technology for producing monoclonal antibody hybridomas is well known (see generally Kenneth, R. H., in Monoclonal Antibodies: A New Dimension In Biological Analyses, Plenum Publishing Corp., New York, N.Y. (1980); Lerner, E. A. (1981) *Yale J. Biol. Med.* 54:387402; Gefter, M. L. et al. (1977) *Somatic Cell Genet.* 3:231–36). Briefly, an immortal cell line (typically a myeloma) is fused to lymphocytes (typically splenocytes) from a mammal immunized with an OAT immunogen as described above, and the culture supernatants of the resulting hybridoma cells are screened to identify a hybridoma producing a monoclonal antibody that binds OAT.

Any of the many well known protocols used for fusing lymphocytes and immortalized cell lines can be applied for the purpose of generating an anti-OAT monoclonal antibody (see, e.g., Galfre, G. et al. (1977) *Nature* 266:55052; Gefter et al. (1977) supra; Lerner (1981) supra; Kenneth (1980) supra). Moreover, the ordinarily skilled worker will appreciate that there are many variations of such methods which also would be useful. Typically, the immortal cell line (e.g., a myeloma cell line) is derived from the same mammalian species as the lymphocytes. For example, murine hybridomas can be made by fusing lymphocytes from a mouse immunized with an immunogenic preparation of the present invention with an immortalized mouse cell line. Preferred immortal cell lines are mouse myeloma cell lines that are sensitive to culture medium containing hypoxanthine, aminopterin and thymidine ("HAT medium"). Any of a number of myeloma cell lines can be used as a fusion partner according to standard techniques, e.g., the P3-NS1/1-Ag4-1, P3-x63-Ag8.653 or Sp2/O-Ag14 myeloma lines. These myeloma lines are available from American Type Culture Collection (ATCC®), 10801 University Boulevard, Manassas, Va. 20110-2209. Typically, HAT-sensitive mouse myeloma cells are fused to mouse splenocytes using polyethylene glycol ("PEG"). Hybridoma cells resulting from the fusion are then selected using HAT medium, which kills unfused and unproductively fused myeloma cells (unfused splenocytes die after several days because they are not transformed). Hybridoma cells producing a monoclonal antibody of the invention are detected by screening the hybridoma culture supernatants for antibodies that bind OAT, e.g., using a standard ELISA assay.

Alternative to preparing monoclonal antibody-secreting hybridomas, a monoclonal anti-OAT antibody can be identified and isolated by screening a recombinant combinatorial immunoglobulin library (e.g., an antibody phage display library) with OAT to thereby isolate immunoglobulin library members that bind OAT. Kits for generating and screening phage display libraries are commercially available (e.g., the Pharmacia *Recombinant Phage Antibody System*, Catalog No. 27-9400-01; and the Stratagene *SurfZAP*™ *Phage Display Kit*, Catalog No. 240612). Additionally, examples of methods and reagents particularly amenable for use in generating and screening antibody display library can be found in, for example, Ladner et al., U.S. Pat. No. 5,223,409; Kang et al., PCT International Publication No. WO 92/18619; Dower et al., PCT International Publication No. WO 91/17271; Winter et al., PCT International Publication WO 92/20791; Markland et al., PCT International Publication No. WO 92/15679; Breitling et al., PCT International Publication WO 93/01288; McCafferty et al., PCT International Publication No. WO 92/01047; Garrard et al., PCT International Publication No. WO 92/09690; Ladner et al., PCT International Publication No. WO 90/02809; Fuchs et al. (1991) *Bio/Technology* 9:1369–1372; Hay et al. (1992) *Hum. Antibod. Hybridomas* 3:81–85; Huse et al. (1989) *Science* 246:1275–1281; Griffiths et al. (1993) *EMBO J.* 12:725–734; Hawkins et al. (1992) *J. Mol. Biol.* 226:889–896; Clackson et al. (1991) *Nature* 352:624–628; Gram et al. (1992) *Proc. Natl. Acad. Sci. USA* 89:3576–3580; Garrard et al. (1991) *Biotechnology* (NY) 9:1373–1377; Hoogenboom et al. (1991) *Nucleic Acids Res.*

19:4133–4137; Barbas et al. (1991) *Proc. Natl. Acad. Sci. USA* 88:7978–7982; and McCafferty et al. (1990) *Nature* 348:552–554.

Additionally, recombinant anti-OAT antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art, for example using methods described in Robinson et al., International Application No. PCT/US86/02269; Akira et al., European Patent Application 184,187; Taniguchi, M., European Patent Application 171, 496; Morrison et al., European Patent Application 173,494; Neuberger et al., PCT International Publication No. WO 86/01533; Cabilly et al., U.S. Pat. No. 4,816,567; Cabilly et al., European Patent Application 125,023; Better et al. (1988) *Science* 240:1041–1043; Liu et al. (1987) *Proc. Natl. Acad. Sci. USA* 84:3439–3443; Liu et al. (1987) *J. Immunol.* 139:3521–3526; Sun et al. (1987) *Proc. Natl. Acad. Sci. USA* 84:214–218; Nishimura et al. (1987) *Cancer Res.* 47:999–1005; Wood et al. (1985) *Nature* 314:446–449; and Shaw et al. (1988) *J. Natl. Cancer Inst.* 80:1553–1559); Morrison, S. L. (1985) *Science* 229:1202–1207; Oi et al. (1986) *Biotechniques* 4:214; Winter, U.S. Pat. No. 5,225, 539; Jones et al. (1986) *Nature* 321:552–525; Verhoeyen et al. (1988) *Science* 239:1534; and Beidler et al. (1988) *J. Immunol.* 141:4053–4060.

An anti-OAT antibody (e.g., monoclonal antibody) can be used to isolate OAT by standard techniques, such as affinity chromatography or immunoprecipitation. An anti-OAT antibody can facilitate the purification of natural OAT from cells and of recombinantly produced OAT expressed in host cells. Moreover, an anti-OAT antibody can be used to detect OAT protein (e.g., in a cellular lysate or cell supernatant) in order to evaluate the abundance and pattern of expression of the OAT protein. Anti-OAT antibodies can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Recombinant Expression Vectors and Host Cells

Another aspect of the invention pertains to vectors, for example recombinant expression vectors, containing an OAT nucleic acid molecule or vectors containing a nucleic acid molecule which encodes an OAT protein (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel (1990) *Methods Enzymol.* 185:3–7. Regulatory sequences include those which direct constitutive expression of a nucleotide sequence in many types of host cells and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors of the invention can be introduced into host cells to thereby produce proteins or peptides, including fusion proteins or peptides, encoded by nucleic acids as described herein (e.g., OAT proteins, mutant forms of OAT proteins, fusion proteins, and the like).

Accordingly, an exemplary embodiment provides a method for producing a protein, preferably an OAT protein, by culturing in a suitable medium a host cell of the invention (e.g., a mammalian host cell such as a non-human mammalian cell) containing a recombinant expression vector, such that the protein is produced.

The recombinant expression vectors of the invention can be designed for expression of OAT proteins in prokaryotic or eukaryotic cells. For example, OAT proteins can be expressed in bacterial cells such as *E. coli*, insect cells (using baculovirus expression vectors) yeast cells or mammalian cells. Suitable host cells are discussed further in Goeddel (1990) supra. Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith, D. B. and Johnson, K. S. (1988) Gene 67:3140), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Purified fusion proteins can be utilized in OAT activity assays (e.g., direct assays or competitive assays described in detail below), or to generate antibodies specific for OAT proteins, for example. In a preferred embodiment, an OAT fusion protein expressed in a retroviral expression vector of the present invention can be utilized to infect bone marrow cells, which are subsequently transplanted into irradiated recipients. The pathology of the subject recipient is then examined after sufficient time has passed (e.g., six (6) weeks).

Examples of suitable inducible non-fusion *E. coli* expression vectors include pTrc (Amann et al. (1988) *Gene* 69:301–315) and pET 11d (Studier et al. (1990) *Methods Enzymol.* 185:60–89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174(DE3) from a resident prophage harboring a T7 gn1 gene under the transcriptional control of the lacUV 5 promoter.

One strategy to maximize recombinant protein expression in *E. coli* is to express the protein in a host bacteria with an impaired capacity to proteolytically cleave the recombinant protein (Gottesman, S. (1990) *Methods Enzymol.* 185:119–128). Another strategy is to alter the nucleic acid sequence of the nucleic acid to be inserted into an expression vector so that the individual codons for each amino acid are those preferentially utilized in *E. coli* (Wada et al. (1992) *Nucleic Acids Res.* 20:2111–2118). Such alteration of nucleic acid sequences of the invention can be carried out by standard DNA synthesis techniques.

In another embodiment, the OAT expression vector is a yeast expression vector. Examples of vectors for expression in yeast *S. cerivisae* include pYepSec 1 (Baldari et al. (1987) *EMBO J.* 6:229–234), pMFa (Kurjan and Herskowitz (1982) *Cell* 30:933–943), pJRY88 (Schultz et al. (1987) *Gene* 54:113–123), pYES2 (Invitrogen Corporation, San Diego, Calif.), and picZ (Invitrogen Corp., San Diego, Calif.).

Alternatively, OAT proteins can be expressed in insect cells using baculovirus expression vectors. Baculovirus vectors available for expression of proteins in cultured insect cells (e.g., Sf 9 cells) include the pAc series (Smith et al. (1983) *Mol. Cell Biol.* 3:2156–2165) and the pVL series (Lucklow and Summers (1989) *Virology* 170:31–39).

In yet another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et al. (1987) *EMBO J.* 6:187–195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J. et al., *Molecular Cloning: A Laboratory Manual.* 2nd, ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268–277), lymphoid-specific promoters (Calame and Eaton (1988) *Adv. Immunol.* 43:235–275), in particular promoters of T cell receptors (Winoto and Baltimore (1989) *EMBO J.* 8:729–733) and immunoglobulins (Banerji et al. (1983) *Cell* 33:729–740; Queen and Baltimore (1983) *Cell* 33:741–748), neuron-specific promoters (e.g., the neurofilament promoter; Byrne and Ruddle (1989) *Proc. Natl. Acad. Sci. USA* 86:5473–5477), pancreas-specific promoters (Edlund et al. (1985) *Science* 230:912–916), and mammary gland-specific promoters (e.g., milk whey promoter; U.S. Pat. No. 4,873, 316 and European Application Publication No. 264,166). Developmentally-regulated promoters are also encompassed, for example the murine hox promoters (Kessel and Gruss (1990) *Science* 249:374–379) and the α-fetoprotein promoter (Campes and Tilghman (1989) *Genes Dev.* 3:537–546).

The invention further provides a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to OAT mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of anti sense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see Weintraub, H. et al. "Antisense RNA as a molecular tool for genetic analysis", *Reviews—Trends in Genetics,* Vol. 1(1) 1986.

Another aspect of the invention pertains to host cells into which an OAT nucleic acid molecule of the invention is introduced, e.g., an OAT nucleic acid molecule within a vector (e.g., a recombinant expression vector) or an OAT nucleic acid molecule containing sequences which allow it to homologously recombine into a specific site of the host cell's genome. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, an OAT protein can be expressed in bacterial cells such as *E. coli*, insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook et al. (*Molecular Cloning: A Laboratory Manual. 2nd, ed., Cold Spring Harbor Laboratory*, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding an OAT protein or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) an OAT protein. Accordingly, the invention further provides methods for producing an OAT protein using the host cells of the invention. In one embodiment, the method comprises culturing the host cell of the invention (into which a recombinant expression vector encoding an OAT protein has been introduced) in a suitable medium such that an OAT protein is produced. In another embodiment, the method further comprises isolating an OAT protein from the medium or the host cell.

The host cells of the invention can also be used to produce non-human transgenic animals. For example, in one embodiment, a host cell of the invention is a fertilized oocyte or an embryonic stem cell into which OAT-coding sequences have been introduced. Such host cells can then be used to create non-human transgenic animals in which exogenous OAT sequences have been introduced into their genome or homologous recombinant animals in which endogenous OAT sequences have been altered. Such animals are useful for studying the function and/or activity of an OAT protein and for identifying and/or evaluating modulators of OAT activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, and the like. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous OAT gene has been altered by homologous recombination between the endogenous gene and an exogenous DNA molecule introduced into a cell of the animal, e.g., an embryonic cell of the animal, prior to development of the animal.

A transgenic animal of the invention can be created by introducing an OAT-encoding nucleic acid into the male pronuclei of a fertilized oocyte, e.g., by microinjection or retroviral infection, and allowing the oocyte to develop in a pseudopregnant female foster animal. The OAT cDNA sequence of SEQ ID NO:4 or 7 can be introduced as a transgene into the genome of a non-human animal. Alternatively, a non-human homologue of a human OAT gene, such as a rat or mouse OAT gene, can be used as a transgene. Alternatively, an OAT gene homologue, such as another OAT family member, can be isolated based on hybridization to the OAT cDNA sequences of SEQ ID NO:4, 6, 7, or 9 (described further in subsection I above) and used as a transgene. Intronic sequences and polyadenylation signals can also be included in the transgene to increase the efficiency of expression of the transgene. A tissue-specific regulatory sequence(s) can be operably linked to an OAT transgene to direct expression of an OAT protein to particular cells. Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., *Manipulating the Mouse Embryo* (Cold Spring Harbor Laboratory Press, Cold Spring Harbor, N.Y., 1986). Similar methods are used for production of other transgenic animals. A transgenic founder animal can be identified based upon the presence of an OAT transgene in its genome and/or expression of OAT mRNA in tissues or cells of the animals. A transgenic founder animal can then be used to breed additional animals carrying the transgene. Moreover, transgenic animals carrying a transgene encoding an OAT protein can further be bred to other transgenic animals carrying other transgenes.

To create a homologous recombinant animal, a vector is prepared which contains at least a portion of an OAT gene into which a deletion, addition or substitution has been introduced to thereby alter, e.g., functionally disrupt, the OAT gene. The OAT gene can be a human gene (e.g., the cDNA of SEQ ID NO:4 or 7), but more preferably, is a non-human homologue of a human OAT gene (e.g., a cDNA isolated by stringent hybridization with the nucleotide sequence of SEQ ID NO:4, 6, 7, or 9), For example, a mouse OAT gene can be used to construct a homologous recombination nucleic acid molecule, e.g., a vector, suitable for altering an endogenous OAT gene in the mouse genome. In a preferred embodiment, the homologous recombination nucleic acid molecule is designed such that, upon homologous recombination, the endogenous OAT gene is functionally disrupted (i.e., no longer encodes a functional protein; also referred to as a "knock out" vector). Alternatively, the homologous recombination nucleic acid molecule can be designed such that, upon homologous recombination, the endogenous OAT gene is mutated or otherwise altered but still encodes functional protein (e.g., the upstream regulatory region can be altered to thereby alter the expression of the endogenous OAT protein). In the homologous recombination nucleic acid molecule, the altered portion of the OAT gene is flanked at its 5' and 3' ends by additional nucleic acid sequence of the OAT gene to allow for homologous recombination to occur between the exogenous OAT gene carried by the homologous recombination nucleic acid molecule and an endogenous OAT gene in a cell, e.g., an embryonic stem cell. The additional flanking OAT nucleic acid sequence is of sufficient length for successful homologous recombination with the endogenous gene. Typically, several kilobases of flanking DNA (both at the 5' and 3' ends) are included in the homologous recombination nucleic acid molecule (see, e.g., Thomas, K. R. and Capecchi, M. R. (1987) *Cell* 51:503 for a description of homologous recombination vectors). The homologous recombination nucleic acid molecule is introduced into a cell, e.g., an embryonic stem cell line (e.g., by electroporation) and cells in which the introduced OAT gene has homologously recombined with the endogenous OAT gene are selected (see e.g., Li, E. et al. (1992) *Cell* 69:915). The selected cells can then be injected into a blastocyst of an animal (e.g., a mouse) to form aggregation chimeras (see e.g., Bradley, A. in *Teratocarcinomas and Embryonic Stem Cells: A Practical Approach*, Robertson, E. J. ed. (IRL, Oxford, 1987) pp. 113–152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination nucleic acid molecules, e.g., vectors, or homologous recombinant animals are described further in Bradley, A. (1991) *Current Opinion in Biotechnology* 2:823–829 and in PCT International Publication Nos.: WO 90/11354 by Le Mouellec et al.; WO 91/01140 by Smithies et al.; WO 92/0968 by Zijistra et al.; and WO 93/04169 by Berns et al.

In another embodiment, transgenic non-humans animals can be produced which contain selected systems which allow for regulated expression of the transgene. One example of such a system is the cre/loxP recombinase system of bacteriophage P1. For a description of the cre/loxP recombinase system, see, e.g., Lakso et al. (1992) *Proc. Natl. Acad. Sci. USA* 89:6232–6236. Another example of a recombinase system is the FLP recombinase system of *Saccharomyces cerevisiae* (O'Gorman et al. (1991) *Science* 251:1351–1355). If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, I. et al. (1997) *Nature* 385:810–813 and PCT International Publication Nos. WO 97/07668 and WO 97/07669. In brief, a cell, e.g., a somatic cell, from the transgenic animal can be isolated and induced to exit the growth cycle and enter $G_O$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell, e.g., the somatic cell, is isolated.

Pharmaceutical Compositions

The OAT nucleic acid molecules, OAT proteins, fragments thereof, anti-OAT antibodies, and OAT modulators (also referred to herein as "active compounds") of the invention can be incorporated into pharmaceutical compositions suitable for administration. Such compositions typically comprise the nucleic acid molecule, protein, or antibody and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., a fragment of an OAT protein or an anti-OAT antibody) in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit large therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of protein or polypeptide (i.e., an effective dosage) ranges from about 0.001 to 30 mg/kg body weight, preferably about 0.01 to 25 mg/kg body weight, more preferably about 0.1 to 20 mg/kg body weight, and even more preferably about 1 to 10 mg/kg, 2 to 9 mg/kg, 3 to 8 mg/kg, 4 to 7 mg/kg, or 5 to 6 mg/kg body weight. The skilled artisan will appreciate that certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment or, preferably, can include a series of treatments.

In a preferred example, a subject is treated with antibody, protein, or polypeptide in the range of between about 0.1 to 20 mg/kg body weight, one time per week for between about 1 to 10 weeks, preferably between 2 to 8 weeks, more preferably between about 3 to 7 weeks, and even more preferably for about 4, 5, or 6 weeks. It will also be appreciated that the effective dosage of antibody, protein, or polypeptide used for treatment may increase or decrease over the course of a particular treatment. Changes in dosage may result and become apparent from the results of diagnostic assays as described herein.

The present invention encompasses agents which modulate expression or activity. An agent may, for example, be a small molecule. For example, such small molecules include, but are not limited to, peptides, peptidomimetics, amino acids, amino acid analogs, polynucleotides, polynucleotide analogs, nucleotides, nucleotide analogs, organic or inorganic compounds (i.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds. It is understood that appropriate doses of small molecule agents depends upon a number of factors within the ken of the ordinarily skilled physician, veterinarian, or researcher. The dose(s) of the small molecule will vary, for example, depending upon the identity, size, and condition of the subject or sample being treated, further depending upon the route by which the composition is to be administered, if applicable, and the effect which the practitioner desires the small molecule to have upon the nucleic acid or polypeptide of the invention.

Exemplary doses include milligram or microgram amounts of the small molecule per kilogram of subject or sample weight (e.g., about 1 microgram per kilogram to about 500 milligrams per kilogram, about 100 micrograms per kilogram to about 5 milligrams per kilogram, or about 1 microgram per kilogram to about 50 micrograms per kilogram. It is furthermore understood that appropriate doses of a small molecule depend upon the potency of the small molecule with respect to the expression or activity to be modulated. Such appropriate doses may be determined using the assays described herein. When one or more of these small molecules is to be administered to an animal (e.g., a human) in order to modulate expression or activity of a polypeptide or nucleic acid of the invention, a physician, veterinarian, or researcher may, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

In certain embodiments of the invention, a modulator of OAT activity is administered in combination with other agents (e.g., a small molecule), or in conjunction with another, complementary treatment regime. For example, in one embodiment, a modulator of OAT activity is used to treat OAT associated disorder. Accordingly, modulation of OAT activity may be used in conjunction with, for example, another agent used to treat the disorder.

Further, an antibody (or fragment thereof) may be conjugated to a therapeutic moiety such as a cytotoxin, a therapeutic agent or a radioactive metal ion. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

The conjugates of the invention can be used for modifying a given biological response, the drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a protein such as tumor necrosis factor, alpha-interferon, beta-interferon, nerve growth factor, platelet derived growth factor, tissue plasminogen activator; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors.

Techniques for conjugating such therapeutic moiety to antibodies are well known, see, e.g., Arnon et al. "Monoclonal Antibodies For Immunotargeting Of Drugs In Cancer Therapy" in *Monoclonal Antibodies And Cancer Therapy*, Reisfeld et al. (eds.), pp. 243–56 (Alan R. Liss, Inc. 1985); Hellstrom et al. "Antibodies For Drug Delivery" in *Controlled Drug Delivery* (2nd Ed.), Robinson et al. (eds.), pp. 623–53 (Marcel Dekker, Inc. 1987); Thorpe "Antibody Carriers Of Cytotoxic Agents In Cancer Therapy: A Review" in *Monoclonal Antibodies '84: Biological And Clinical Applications*, Pinchera et al. (eds.), pp. 475–506 (1985); "Analysis, Results, And Future Prospective Of The Therapeutic Use Of Radiolabeled Antibody In Cancer Therapy" in *Monoclonal Antibodies For Cancer Detection And Therapy*, Baldwin et al. (eds.), pp. 303–16 (Academic Press 1985); and Thorpe et al. "The Preparation And Cytotoxic Properties Of Antibody-Toxin Conjugates" Immunol. Rev. 62:119–58 (1982). Alternatively, an antibody can be conjugated to a second antibody to form an antibody heteroconjugate as described by Segal in U.S. Pat. No. 4,676,980.

The nucleic acid molecules of the invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054–3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The pharmaceutical compositions can be included in a container, pack, or dispenser together with instructions for administration.

Uses and Methods of the Invention

The nucleic acid molecules, proteins, protein homologues, and antibodies described herein can be used in one or more of the following methods: a) screening assays; b) predictive medicine (e.g., diagnostic assays, prognostic assays, monitoring clinical trials, and pharmacogenetics); and c) methods of treatment (e.g., therapeutic and prophylactic). As described herein, an OAT protein of the invention has one or more of the following activities: (i) interaction with an OAT substrate or target molecule; (ii) transport of an OAT substrate across a membrane; (iii) interaction with and/or modulation of a second non-OAT protein; (iv) modulation of cellular signaling and/or gene transcription (e.g., either directly or indirectly); (v) protection of cells and/or tissues from organic anions; and/or (vi) modulation of hormonal responses.

The isolated nucleic acid molecules of the invention can be used, for example, to express OAT protein (e.g., via a recombinant expression vector in a host cell in gene therapy applications), to detect OAT mRNA (e.g., in a biological sample) or a genetic alteration in an OAT gene, and to modulate OAT activity, as described further below. The OAT proteins can be used to treat disorders characterized by insufficient or excessive transport of an OAT substrate or production of OAT inhibitors. In addition, the OAT proteins can be used to screen for naturally occurring OAT substrates or target molecules, to screen for drugs or compounds which modulate OAT activity, as well as to treat disorders characterized by insufficient or excessive production of OAT protein or production of OAT protein forms which have decreased, aberrant or unwanted activity compared to OAT wild type protein (e.g., an OAT-associated disorder).

Moreover, the anti-OAT antibodies of the invention can be used to detect and isolate OAT proteins, regulate the bioavailability of OAT proteins, and modulate OAT activity.

Screening Assays:

The invention provides a method (also referred to herein as a "screening assay") for identifying modulators, i.e., candidate or test compounds or agents (e.g., peptides, peptidomimetics, small molecules or other drugs) which bind to OAT proteins, have a stimulatory or inhibitory effect on, for example, OAT expression or OAT activity, or have a stimulatory or inhibitory effect on, for example, the transport, expression or activity of an OAT substrate or target molecule.

In one embodiment, the invention provides assays for screening candidate or test compounds which are substrates or target molecules of an OAT protein or polypeptide or biologically active portion thereof. In another embodiment, the invention provides assays for screening candidate or test compounds which bind to or modulate the activity of an OAT protein or polypeptide or biologically active portion thereof. The test compounds of the present invention can be obtained using any of the numerous approaches in combinatorial library methods known in the art, including: biological libraries; spatially addressable parallel solid phase or solution phase libraries; synthetic library methods requiring deconvolution; the 'one-bead one-compound' library method; and synthetic library methods using affinity chromatography selection. The biological library approach is limited to peptide libraries, while the other four approaches are applicable to peptide, non-peptide oligomer or small molecule libraries of compounds (Lam, K. S. (1997) *Anticancer Drug Des.* 12:45).

Examples of methods for the synthesis of molecular libraries can be found in the art, for example, in: DeWitt et al. (1993) *Proc. Natl. Acad. Sci. USA* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and Gallop et al. (1994) *J. Med. Chem.* 37:1233.

Libraries of compounds may be presented in solution (e.g., Houghten (1992) *Biotechniques* 13:412421), or on beads (Lam (1991) *Nature* 354:82–84), chips (Fodor (1993) *Nature* 364:555–556), bacteria (Ladner U.S. Pat. No. 5,223,409), spores (Ladner U.S. Pat. No. '409), plasmids (Cull et al. (1992) *Proc. Natl. Acad. Sci. USA* 89:1865–1869) or on phage (Scott and Smith (1990) *Science* 249:386–390); (Devlin (1990) *Science* 249:404406); (Cwirla et al. (1990) *Proc. Natl. Acad. Sci. USA* 87:6378–6382); (Felici (1991) *J. Mol. Biol.* 222:301–310); (Ladner supra.).

In one embodiment, an assay is a cell-based assay in which a cell which expresses an OAT protein or biologically active portion thereof is contacted with a test compound and the ability of the test compound to modulate OAT activity is determined. Determining the ability of the test compound to modulate OAT activity can be accomplished by monitoring, for example, transport of substrates across membranes and/or levels of gene transcription. The cell, for example, can be of a mammalian origin.

The ability of the test compound to modulate binding of a substrate or target molecule to OAT can also be determined. Determining the ability of the test compound to modulate OAT binding to a substrate or target molecule can be accomplished, for example, by coupling the OAT substrate or target molecule with a radioisotope or enzymatic label such that binding of the OAT substrate or target molecule to OAT can be determined by detecting the labeled OAT substrate or target molecule in a complex. Alternatively, OAT could be coupled with a radioisotope or enzymatic label to monitor the ability of a test compound to modulate OAT binding to an OAT substrate or target molecule in a complex. Determining the ability of the test compound to bind OAT can be accomplished, for example, by coupling the compound with a radioisotope or enzymatic label such that binding of the compound to OAT can be determined by detecting the labeled compound in a complex. For example, compounds (e.g., OAT substrates) can be labeled with $^{125}$I, $^{35}$S, $^{14}$C, or $^{3}$H, either directly or indirectly, and the radioisotope detected by direct counting of radioemission or by scintillation counting. Alternatively, compounds can be enzymatically labeled with, for example, horseradish peroxidase, alkaline phosphatase, or luciferase, and the enzymatic label detected by determination of an appropriate substrate to product.

It is also within the scope of this invention to determine the ability of a compound (e.g., an OAT substrate) to interact with OAT without the labeling of any of the interactants. For example, a microphysiometer can be used to detect the interaction of a compound with OAT without the labeling of either the compound or the OAT. McConnell, H. M. et al. (1992) *Science* 257:1906–1912. As used herein, a "microphysiometer" (e.g., Cytosensor) is an analytical instrument that measures the rate at which a cell acidifies its environment using a light-addressable potentiometric sensor (LAPS). Changes in this acidification rate can be used as an indicator of the interaction between a compound and OAT.

In another embodiment, an assay is a cell-based assay comprising contacting a cell which expresses OAT with an OAT target molecule (e.g., an OAT substrate) and a test compound and determining the ability of the test compound to modulate (e.g., stimulate or inhibit) the activity (e.g., transport) or cellular location of the OAT substrate or target molecule. Determining the ability of the test compound to modulate the activity of an OAT substrate or target molecule can be accomplished, for example, by determining the ability of the OAT protein to bind to or interact with the OAT substrate or target molecule or by determining the cellular localization of the OAT substrate or target molecule.

Determining the ability of the OAT protein, or a biologically active fragment thereof, to bind to or interact with or transport an OAT substrate or target molecule can be accomplished by one of the methods described above for determining direct binding. In a preferred embodiment, determining the ability of the OAT protein to bind to or interact with an OAT substrate or target molecule can be accomplished by determining the activity or cellular localization of the substrate or target molecule. For example, the activity of the substrate or target molecule can be determined by detecting induction of a cellular response (e.g., changes in intracellular substrate concentration), detecting a secondary or indirect activity of the substrate or target molecule, detecting the induction of a reporter gene (comprising a target-responsive regulatory element operatively linked to a nucleic acid encoding a detectable marker, e.g., luciferase), or detecting a target-regulated cellular response (i.e., a hormonal response). In other embodiments, the assays described above are carried out in a cell-free context (e.g., in an artificial membrane, vesicle, or micelle preparation).

In yet another embodiment, an assay of the present invention is a cell-free assay in which an OAT protein or biologically active portion (e.g., a portion which possesses the ability to transport or interact with a substrate or target molecule) thereof is contacted with a test compound and the ability of the test compound to bind to the OAT protein or biologically active portion thereof is determined. Preferred biologically active portions of the OAT proteins to be used in assays of the present invention include fragments which participate in interactions with non-OAT molecules, e.g., fragments with high surface probability scores (see, for example, FIGS. 7 and 8). Binding of the test compound to the OAT protein can be determined either directly or indirectly as described above. In a preferred embodiment, the assay includes contacting the OAT protein or biologically active portion thereof with a known compound which binds OAT to form an assay mixture, contacting the assay mixture with a test compound, and determining the ability of the test compound to interact with an OAT protein, wherein determining the ability of the test compound to interact with an OAT protein comprises determining the ability of the test compound to preferentially bind to OAT or biologically active portion thereof as compared to the known compound.

In another embodiment, the assay is a cell-free assay in which an OAT protein or biologically active portion thereof is contacted with a test compound and the ability of the test compound to modulate (e.g., stimulate or inhibit) the activity of the OAT protein or biologically active portion thereof is determined. Determining the ability of the test compound to modulate the activity of an OAT protein can be accomplished, for example, by determining the ability of the OAT protein to bind to an OAT substrate or target molecule by one of the methods described above for determining direct binding. Determining the ability of the OAT protein to bind to an OAT substrate or target molecule can also be accomplished using a technology such as real-time Biomolecular Interaction Analysis (BIA). Sjolander, S. and Urbaniczky, C. (1991) Anal. Chem. 63:2338–2345 and Szabo et al. (1995) Curr. Opin. Struct. Biol. 5:699–705. As used herein, "BIA" is a technology for studying biospecific interactions in real time, without labeling any of the interactants (e.g., BIAcore). Changes in the optical phenomenon of surface plasmon resonance (SPR) can be used as an indication of real-time reactions between biological molecules.

In an alternative embodiment, determining the ability of the test compound to modulate the activity of an OAT protein can be accomplished by determining the ability of the OAT protein to further modulate the activity of a downstream effector of an OAT target molecule. For example, the activity of the effector molecule on an appropriate target can be determined or the binding of the effector to an appropriate target can be determined as previously described.

In yet another embodiment, the cell-free assay involves contacting an OAT protein or biologically active portion thereof with a known compound which binds to or is transported by the OAT protein to form an assay mixture, contacting the assay mixture with a test compound, and determining the ability of the test compound to interact with the OAT protein, wherein determining the ability of the test compound to interact with the OAT protein comprises determining the ability of the OAT protein to preferentially bind to, transport, or modulate the activity of an OAT substrate or target molecule.

The cell-free assays of the present invention are amenable to use of both soluble and/or membrane-bound forms of isolated proteins (e.g., OAT proteins or biologically active portions thereof). In the case of cell-free assays in which a membrane-bound form of an isolated protein is used it may be desirable to utilize a solubilizing agent such that the membrane-bound form of the isolated protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, 3-[(3-cholamidopropyl)dimethylamminio]-1-propane sulfonate (CHAPS), 3-[(3-cholamidopropyl) dimethylamminio]-2-hydroxy-1-propane sulfonate (CHAPSO), or N-dodecyl=N,N-dimethyl-3-ammonio-1-propane sulfonate.

In more than one embodiment of the above assay methods of the present invention, it may be desirable to immobilize either OAT or its substrate or target molecule to facilitate separation of complexed from uncomplexed forms of one or both of the proteins, as well as to accommodate automation of the assay. Binding of a test compound to an OAT protein, or interaction of an OAT protein with a substrate or target molecule in the presence and absence of a candidate compound, can be accomplished in any vessel suitable for containing the reactants. Examples of such vessels include microtiter plates, test tubes, and micro-centrifuge tubes. In one embodiment, a fusion protein can be provided which adds a domain that allows one or both of the proteins to be bound to a matrix. For example, glutathione-S-transferase/ OAT fusion proteins or glutathione-S-transferase/target fusion proteins can be adsorbed onto glutathione sepharose beads (Sigma Chemical, St. Louis, Mo.) or glutathione derivatized micrometer plates, which are then combined with the test compound or the test compound and either the non-adsorbed target protein or OAT protein, and the mixture incubated under conditions conducive to complex formation (e.g., at physiological conditions for salt and pH). Following incubation, the beads or microtiter plate wells are washed to remove any unbound components, the matrix immobilized in the case of beads, complex determined either directly or indirectly, for example, as described above. Alternatively, the complexes can be dissociated from the matrix, and the level of OAT binding or activity determined using standard techniques.

Other techniques for immobilizing proteins on matrices can also be used in the screening assays of the invention. For example, either an OAT protein or an OAT substrate or target molecule can be immobilized utilizing conjugation of biotin and streptavidin. Biotinylated OAT protein, substrates or target molecules can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical). Alternatively, antibodies reactive with OAT protein, substrates or target molecules but which do not interfere with binding of the OAT protein to its substrate, or target molecule can be derivatized to the wells of the plate, and unbound target or OAT protein trapped in the wells by antibody conjugation. Methods for detecting such complexes, in addition to those described above for the GST-immobilized complexes, include immunodetection of complexes using antibodies reactive with the OAT protein or target molecule, as well as enzyme-linked assays which rely on detecting an enzymatic activity associated with the OAT protein or target molecule.

In another embodiment, modulators of OAT expression are identified in a method wherein a cell is contacted with a candidate compound and the expression of OAT mRNA or protein in the cell is determined. The level of expression of OAT mRNA or protein in the presence of the candidate compound is compared to the level of expression of OAT mRNA or protein in the absence of the candidate compound. The candidate compound can then be identified as a modulator of OAT expression based on this comparison. For example, when expression of OAT mRNA or protein is greater (statistically significantly greater) in the presence of the candidate compound than in its absence, the candidate compound is identified as a stimulator of OAT mRNA or protein expression. Alternatively, when expression of OAT mRNA or protein is less (statistically significantly less) in the presence of the candidate compound than in its absence, the candidate compound is identified as an inhibitor of OAT mRNA or protein expression. The level of OAT mRNA or protein expression in the cells can be determined by methods described herein for detecting OAT mRNA or protein.

In yet another aspect of the invention, the OAT proteins can be used as "bait proteins" in a two-hybrid assay or three-hybrid assay (see, e.g., U.S. Pat. No. 5,283,317; Zervos et al. (1993) *Cell* 72:223–232; Madura et al. (1993) *J. Biol. Chem.* 268:12046–12054; Bartel et al. (1993) *Biotechniques* 14:920–924; Iwabuchi et al. (1993) *Oncogene* 8:1693–1696; and Brent WO94/10300), to identify other proteins, which bind to or interact with OAT ("OAT-binding proteins" or "OAT-bp") and are involved in OAT activity. Such OAT-binding proteins are also likely to be involved in the propagation of signals by the OAT proteins or OAT targets as, for example, downstream elements of an OAT-mediated signaling pathway. Alternatively, such OAT-binding proteins may be OAT inhibitors.

The two-hybrid system is based on the modular nature of most transcription factors, which consist of separable DNA-binding and activation domains. Briefly, the assay utilizes two different DNA constructs. In one construct, the gene that codes for an OAT protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an OAT-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the OAT protein.

In another aspect, the invention pertains to a combination of two or more of the assays described herein. For example, a modulating agent can be identified using a cell-based or a cell free assay, and the ability of the agent to modulate the activity of an OAT protein can be confirmed in vivo, e.g., in an animal such as an animal model for organic anion sensitivity or an animal model with dysregulated organic anion transport.

This invention further pertains to novel agents identified by the above-described screening assays. Accordingly, it is within the scope of this invention to further use an agent identified as described herein in an appropriate animal model. For example, an agent identified as described herein (e.g., an OAT substrate, an OAT target molecule, an OAT modulating agent, an antisense OAT nucleic acid molecule, an OAT-specific antibody, or an OAT binding partner) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein.

Detection Assays

Portions or fragments of the cDNA sequences identified herein (and the corresponding complete gene sequences) can be used in numerous ways as polynucleotide reagents. For example, the se sequences can be used to: (i) map their respective genes on a chromosome; and, thus, locate gene regions associated with genetic disease; (ii) identify an individual from a minute biological sample (tissue typing); and (iii) aid in forensic identification of a biological sample. These applications are described in the subsections below.

Chromosome Mapping

Once the sequence (or a portion of the sequence) of a gene has been isolated, this sequence can be used to map the location of the gene on a chromosome. This process is called chromosome ma pp ing. Accord ingly, portions or fragments of the OAT nucleotide sequences, described herein, can be used to map the location of the OAT ge nes on a chromosome. The mapping of the OAT sequences to chromosomes is an important first step in correlating these sequences with genes associated with disease.

Briefly, OAT genes can be mapped to chromosomes by preparing PCR primers (preferably 15–25 bp in length) from the OAT nucleotide sequences. Computer analysis of the OAT sequences can be used to predict primers that do not span more than one exon in the genomic DNA, thus complicating the amplification process. These primers can then be used for PCR screening of somatic cell hybrids containing individual human chromosomes. Only those hybrids containing the human gene corresponding to the OAT sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but human cells can, the one human chromosome that contains the gene encoding the needed enzyme, will be retained. By using various media, panels of hybrid cell lines can be established. Each cell line in a panel contains either a single human chromosome or a small number of human chromosomes, and a full set of mouse chromosomes, allowing easy mapping of individual genes to specific human chromosomes (D'Eustachio P. et al. (1983) *Science* 220:919–924). Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. Using the OAT nucleotide sequences to design oligonucleotide primers, sublocalization can be achieved with panels of fragments from specific chromosomes. Other mapping strategies which can similarly be used to map an OAT sequence to its chromosome include in situ hybridization (described in Fan, Y. et al. (1990) *Proc. Natl. Acad. Sci. USA* 87:6223–27), pre-screening with labeled flow-sorted chromosomes, and pre-selection by hybridization to chromosome-specific cDNA libraries.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical such as colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases will suffice to get good results at a reasonable amount of time. For a review of this technique, see Verma et al., *Human Chromosomes: A Manual of Basic Techniques* (Pergamon Press, New York 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. (Such data are found, for example, in McKusick, V., Mendelian Inheritance in Man, available on-line through Johns Hopkins University Welch Medical Library.) The relationship between a gene and a disease, mapped to the same chromosomal region, can then be identified through linkage analysis (co-inheritance of physically adjacent genes), described in, for example, Egeland, J. et al. (1987) *Nature* 325:783–787.

Moreover, differences in the DNA sequences between individuals affected and unaffected with a disease associated with the OAT gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing

The OAT sequences of the present invention can also be used to identify individuals from minute biological samples. The United States military, for example, is considering the use of restriction fragment length polymorphism (RFLP) for identification of its personnel. In this technique, an individual's genomic DNA is digested with one or more restriction enzymes, and probed on a Southern blot to yield unique bands for identification. This method does not suffer from the current limitations of "Dog Tags" which can be lost, switched, or stolen, making positive identification difficult. The sequences of the present invention are useful as additional DNA markers for RFLP (described in U.S. Pat. No. 5,272,057).

Furthermore, the sequences of the present invention can be used to provide an alternative technique which determines the actual base-by-base DNA sequence of selected portions of an individual's genome. Thus, the OAT nucleotide sequences described herein can be used to prepare two PCR primers from the 5' and 3' ends of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the present invention can be used to obtain such identification sequences from individuals and from tissue. The OAT nucleotide sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences of SEQ ID NO:4 or 7 can comfortably provide positive individual identification with a panel of perhaps 10 to 1,000 primers which each yield a noncoding amplified sequence of 100 bases. If predicted coding sequences, such as those in SEQ ID NO:6 or 9 are used, a more appropriate number of primers for positive individual identification would be 500–2,000.

If a panel of reagents from OAT nucleotide sequences described herein is used to generate a unique identification database for an individual, those same reagents can later be used to identify tissue from that individual. Using the unique identification database, positive identification of the individual, living or dead, can be made from extremely small tissue samples.

Use of Partial OAT Sequences in Forensic Biology

DNA-based identification techniques can also be used in forensic biology. Forensic biology is a scientific field employing genetic typing of biological evidence found at a crime scene as a means for positively identifying, for example, a perpetrator of a crime. To make such an identification, PCR technology can be used to amplify DNA sequences taken from very small biological samples such as tissues, e.g., hair or skin, or body fluids, e.g., blood, saliva, or semen found at a crime scene. The amplified sequence can then be compared to a standard, thereby allowing identification of the origin of the biological sample.

The sequences of the present invention can be used to provide polynucleotide reagents, e.g., PCR primers, targeted to specific loci in the human genome, which can enhance the reliability of DNA-based forensic identifications by, for example, providing another "identification marker" (i.e., another DNA sequence that is unique to a particular individual). As mentioned above, actual base sequence information can be used for identification as an accurate alternative to patterns formed by restriction enzyme generated fragments. Sequences targeted to noncoding regions of SEQ ID NO:4 or 7 are particularly appropriate for this use as greater numbers of polymorphisms occur in the noncoding regions, making it easier to differentiate individuals using this technique. Examples of polynucleotide reagents include the OAT nucleotide sequences or portions thereof, e.g., fragments derived from the noncoding regions of SEQ ID NO:4 or 7 having a length of at least 20 bases, preferably at least 30 bases.

The OAT nucleotide sequences described herein can further be used to provide polynucleotide reagents, e.g., labeled or labelable probes which can be used in, for example, an in situ hybridization technique, to identify a specific tissue, e.g., an OAT-expressing tissue. This can be very useful in cases where a forensic pathologist is presented with a tissue of unknown origin. Panels of such OAT probes can be used to identify tissue by species and/or by organ type.

In a similar fashion, these reagents, e.g., OAT primers or probes can be used to screen tissue culture for contamination (i.e., screen for the presence of a mixture of different types of cells in a culture).

Predictive Medicine:

The present invention also pertains to the field of predictive medicine in which diagnostic assays, prognostic assays, and monitoring clinical trials are used for prognostic (predictive) purposes to thereby treat an individual prophylactically. Accordingly, one aspect of the present invention relates to diagnostic assays for determining OAT protein and/or nucleic acid expression as well as OAT activity, in the context of a biological sample (e.g., blood, serum, cells, or tissue) to thereby determine whether an individual is afflicted with a disease or disorder, or is at risk of developing a disorder, associated with aberrant or unwanted OAT expression or activity. The invention also provides for prognostic (or predictive) assays for determining whether an individual is at risk of developing a disorder associated with OAT protein, nucleic acid expression or activity. For example, mutations in an OAT gene can be assayed in a biological sample. Such assays can be used for prognostic or predictive purpose to thereby prophylactically treat an individual prior to the onset of a disorder characterized by or associated with OAT protein, nucleic acid expression or activity.

Another aspect of the invention pertains to monitoring the influence of agents (e.g., drugs, compounds) on the expression or activity of OAT in clinical trials.

These and other agents are described in further detail in the following sections.

Diagnostic Assays

An exemplary method for detecting the presence or absence of OAT protein, polypeptide or nucleic acid in a biological sample involves obtaining a biological sample from a test subject and contacting the biological sample with a compound or an agent capable of detecting OAT protein, polypeptide or nucleic acid (e.g., mRNA, genomic DNA) that encodes OAT protein such that the presence of OAT protein or nucleic acid is detected in the biological sample. In another aspect, the present invention provides a method for detecting the presence of OAT activity in a biological sample by contacting the biological sample with an agent capable of detecting an indicator of OAT activity such that the presence of OAT activity is detected in the biological sample. A preferred agent for detecting OAT mRNA or genomic DNA is a labeled nucleic acid probe capable of hybridizing to OAT mRNA or genomic DNA. The nucleic acid probe can be, for example, a full-length OAT nucleic acid, such as the nucleic acid of SEQ ID NO:4, 6, 7, or 9, or a portion thereof, such as an oligonucleotide of at least 15, 30, 50, 100, 250 or 500 nucleotides in length and sufficient to specifically hybridize under stringent conditions to OAT mRNA or genomic DNA. Other suitable probes for use in the diagnostic assays of the invention are described herein.

A preferred agent for detecting OAT protein is an antibody capable of binding to OAT protein, preferably an antibody with a detectable label. Antibodies can be polyclonal, or more preferably, monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin. The term "biological sample" is intended to include tissues, cells and biological fluids isolated from a subject, as well as tissues, cells and fluids present within a subject. That is, the detection method of the invention can be used to detect OAT mRNA, protein, or genomic DNA in a biological sample in vitro as well as in vivo. For example, in vitro techniques for detection of OAT mRNA include Northern hybridizations and in situ hybridizations. In vitro techniques for detection of OAT protein include enzyme linked immunosorbent assays (ELISAs), Western blots, immunoprecipitations and immunofluorescence. In vitro techniques for detection of OAT genomic DNA include Southern hybridizations. Furthermore, in vivo techniques for detection of an OAT protein include introducing into a subject a labeled anti-OAT antibody. For example, the antibody can be labeled with a radioactive marker whose presence and location in a subject can be detected by standard imaging techniques.

The present invention also provides diagnostic assays for identifying the presence or absence of a genetic alteration characterized by at least one of (i) aberrant modification or mutation of a gene encoding an OAT protein; (ii) aberrant expression of a gene encoding an OAT protein; (iii) misregulation of the gene; and (iv) aberrant post-translational modification of the gene, wherein a wild-type form of the gene encodes a protein with an OAT activity. "Misexpression or aberrant expression", as used herein, refers to a non-wild type pattern of gene expression, at the RNA or protein level. It includes, but is not limited to, expression at non-wild type levels (e.g., over or under expression); a pattern of expression that differs from wild type in terms of the time or stage at which the gene is expressed (e.g., increased or decreased expression (as compared with wild type) at a predetermined developmental period or stage); a pattern of expression that differs from wild type in terms of decreased expression (as compared with wild type) in a predetermined cell type or tissue type; a pattern of expression that differs from wild type in terms of the splicing size, amino acid sequence, post-transitional modification, or biological activity of the expressed polypeptide; a pattern of expression that differs from wild type in terms of the effect of an environmental stimulus or extracellular stimulus on expression of the gene (e.g., a pattern of increased or decreased expression (as compared with wild type) in the presence of an increase or decrease in the strength of the stimulus).

In one embodiment, the biological sample contains protein molecules from the test subject. Alternatively, the biological sample can contain mRNA molecules from the test subject or genomic DNA molecules from the test subject. A preferred biological sample is a serum sample isolated by conventional means from a subject.

In another embodiment, the methods further involve obtaining a control biological sample from a control subject, contacting the control sample with a compound or agent capable of detecting OAT protein, mRNA, or genomic DNA, such that the presence of OAT protein, mRNA or genomic DNA is detected in the biological sample, and comparing the presence of OAT protein, mRNA or genomic DNA in the control sample with the presence of OAT protein, mRNA or genomic DNA in the test sample.

The invention also encompasses kits for detecting the presence of OAT in a biological sample. For example, the kit can comprise a labeled compound or agent capable of detecting OAT protein or mRNA in a biological sample; means for determining the amount of OAT in the sample; and means for comparing the amount of OAT in the sample with a standard. The compound or agent can be packaged in a suitable container. The kit can further comprise instructions for using the kit to detect OAT protein or nucleic acid.

Prognostic Assays

The diagnostic methods described herein can furthermore be utilized to identify subjects having or at risk of developing a disease or disorder associated with aberrant or unwanted OAT expression or activity. As used herein, the term "aberrant" includes an OAT expression or activity which deviates from the wild type OAT expression or activity. Aberrant expression or activity includes increased or decreased expression or activity, as well as expression or activity which does not follow the wild type developmental pattern of expression or the subcellular pattern of expression. For example, aberrant OAT expression or activity is intended to include the cases in which a mutation in the OAT gene causes the OAT gene to be under-expressed or over-expressed and situations in which such mutations result in a non-functional OAT protein or a protein which does not function in a wild-type fashion, e.g., a protein which does not interact with or transport an OAT substrate or target molecule, or one which interacts with a non-OAT substrate or target molecule. As used herein, the term "unwanted" includes an unwanted phenomenon involved in a biological response such as the improper cellular localization of an OAT substrate or deregulated cell proliferation. For example, the term unwanted includes an OAT expression or activity which is undesirable in a subject.

The assays described herein, such as the preceding diagnostic assays or the following assays, can be utilized to identify a subject having or at risk of developing an OAT associated disorder, e.g., a disorder associated with a misregulation in OAT protein activity or nucleic acid expression, such as a CNS disorder (e.g., a cognitive or neurodegenerative disorder), a cellular proliferation, growth, differentiation, or migration disorder, a cardiovascular disorder, a musculoskeletal disorder, an immune disorder, or a hormonal disorder. Alternatively, the prognostic assays can be utilized to identify a subject having or at risk for developing a disorder associated with a misregulation in OAT protein activity or nucleic acid expression, such as a CNS disorder (e.g., a cognitive or neurodegenerative disorder), a cellular proliferation, growth, differentiation, or migration disorder, a cardiovascular disorder, a musculoskeletal disorder, an immune disorder, or a hormonal disorder. Thus, the present invention provides a method for identifying a disease or disorder associated with aberrant or unwanted OAT expression or activity in which a test sample is obtained from a subject and OAT protein or nucleic acid (e.g., mRNA or genomic DNA) is detected, wherein the presence of OAT protein or nucleic acid is diagnostic for a subject having or at risk of developing a disease or disorder associated with aberrant or unwanted OAT expression or activity. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant or unwanted OAT expression or activity. For example, such methods can be used to determine whether a subject can be effectively treated with an agent for a CNS disorder (e.g., a cognitive or neurodegenerative disorder), a cellular proliferation, growth, differentiation, or migration disorder, a cardiovascular disorder, a musculoskeletal disorder, an immune disorder, or a hormonal disorder. Thus, the present invention provides methods for determining whether a subject can be effectively treated with an agent for a disorder associated with aberrant or unwanted OAT expression or activity in which a test sample is obtained and OAT protein or nucleic acid expression or activity is detected (e.g., wherein the abundance of OAT protein or nucleic acid expression or activity is diagnostic for a subject that can be administered the agent to treat a disorder associated with aberrant or unwanted OAT expression or activity).

The methods of the invention can also be used to detect genetic alterations in an OAT gene, thereby determining if a subject with the altered gene is at risk for a disorder characterized by misregulation in OAT protein activity or nucleic acid expression, such as a CNS disorder (e.g., a cognitive or neurodegenerative disorder), a cellular proliferation, growth, differentiation, or migration disorder, a cardiovascular disorder, a musculoskeletal disorder, an immune disorder, or a hormonal disorder. In preferred embodiments, the methods include detecting, in a sample of cells from the subject, the presence or absence of a genetic alteration characterized by at least one of an alteration affecting the integrity of a gene encoding an OAT-protein, or the mis-expression of the OAT gene. For example, such genetic alterations can be detected by ascertaining the existence of at least one of 1) a deletion of one or more nucleotides from an OAT gene; 2) an addition of one or more nucleotides to an OAT gene; 3) a substitution of one or more nucleotides of an OAT gene, 4) a chromosomal rearrangement of an OAT gene; 5) an alteration in the level of a messenger RNA transcript of an OAT gene, 6) aberrant modification of an OAT gene, such as of the methylation pattern of the genomic DNA, 7) the presence of a non-wild type splicing pattern of a messenger RNA transcript of an OAT gene, 8) a non-wild type level of an OAT-protein, 9) allelic loss of an OAT gene, and 10) inappropriate post-translational modification of an OAT-protein. As described herein, there are a large number of assays known in the art which can be used for detecting alterations in an OAT gene. A preferred biological sample is a tissue or serum sample isolated by conventional means from a subject.

In certain embodiments, detection of the alteration involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) *Science* 241:1077–1080; and Nakazawa et al. (1994) *Proc. Natl. Acad. Sci. USA* 91:360–364), the latter of which can be particularly useful for detecting point mutations in the OAT-gene (see Abravaya et al. (1995) *Nucleic Acids Res.* 23:675–682). This method can include the steps of collecting a sample of cells from a subject, isolating nucleic acid (e.g., genomic, mRNA or both) from the cells of the sample, contacting the nucleic acid sample with one or more primers which specifically hybridize to an OAT gene under conditions such that hybridization and amplification of the OAT-gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli, J. C. et al. (1990) *Proc. Natl. Acad. Sci. USA* 87:1874–1878), transcriptional amplification system (Kwoh, D. Y. et al. (1989) *Proc. Natl. Acad. Sci. USA* 86:1173–1177), Q-Beta Replicase (Lizardi, P. M. et al. (1988) *Bio-Technology* 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in an OAT gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, for example, U.S. Pat. No. 5,498,531) can be used to score for the presence of specific mutations by development or loss of a ribozyme cleavage site.

In other embodiments, genetic mutations in OAT can be identified by hybridizing a sample and control nucleic acids, e.g., DNA or RNA, to high density arrays containing hundreds or thousands of oligonucleotides probes (Cronin, M. T. et al. (1996) *Human Mutation* 7:244–255; Kozal, M. J. et al. (1996) *Nature Medicine* 2:753–759). For example, genetic mutations in OAT can be identified in two dimensional arrays containing light-generated DNA probes as described in Cronin, M. T. et al. (1996) supra. Briefly, a first hybridization array of probes can be used to scan through long stretches of DNA in a sample and control to identify base changes between the sequences by making linear arrays of sequential overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the OAT gene and detect mutations by comparing the sequence of the sample OAT with the corresponding wild-type (control) sequence. Examples of sequencing reactions include those based on techniques developed by Maxam and Gilbert ((1977) *Proc. Natl. Acad. Sci. USA* 74:560) or Sanger ((1977) *Proc. Natl. Acad. Sci. USA* 74:5463). It is also contemplated that any of a variety of automated sequencing procedures can be utilized when performing the diagnostic assays (Naeve, C. W. (1995) *Biotechniques* 19:448), including sequencing by mass spectrometry (see, e.g., PCT International Publication No. WO 94/16101; Cohen et al. (1996) *Adv. Chromatogr.* 36:127–162; and Griffin et al. (1993) *Appl. Biochem. Biotechnol.* 38:147–159).

Other methods for detecting mutations in the OAT gene include methods in which protection from cleavage agents is used to detect mismatched bases in RNA/RNA or RNA/DNA heteroduplexes (Myers et al. (1985) *Science* 230:1242). In general, the art technique of "mismatch cleavage" starts by providing heteroduplexes formed by hybridizing (labeled) RNA or DNA containing the wild-type OAT sequence with potentially mutant RNA or DNA obtained from a tissue sample. The double-stranded duplexes are treated with an agent which cleaves single-stranded regions of the duplex such as which will exist due to basepair mismatches between the control and sample strands. For instance, RNA/DNA duplexes can be treated with RNase and DNA/DNA hybrids treated with S1 nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, for example, Cotton et al. (1988) *Proc. Natl. Acad. Sci. USA* 85:4397; Saleeba et al. (1992) *Methods Enzymol.* 217:286–295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in OAT cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657–1662). According to an exemplary embodiment, a probe based on an OAT sequence, e.g., a wild-type OAT sequence, is hybridized to a cDNA or other DNA product from a test cell(s). The duplex is treated with a DNA mismatch repair enzyme, and the cleavage products, if any, can be detected from electrophoresis protocols or the like. See, for example, U.S. Pat. No. 5,459,039.

In other embodiments, alterations in electrophoretic mobility will be used to identify mutations in OAT genes. For example, single strand conformation polymorphism (SSCP) may be used to detect differences in electrophoretic mobility between mutant and wild type nucleic acids (Orita et al. (1989) *Proc Natl. Acad. Sci USA* 86:2766, see also Cotton (1993) *Mutat. Res.* 285:125–144; and Hayashi (1992) *Genet. Anal. Tech. Appl.* 9:73–79). Single-stranded DNA fragments of sample and control OAT nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment the movement of mutant or wild-type fragments in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys Chem* 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) *Nature* 324:163); Saiki et al. (1989) *Proc. Natl. Acad. Sci USA* 86:6230). Such allele specific oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al. (1989) *Nucleic Acids Res.* 17:2437–2448) or at the extreme 3' end of one primer where, under appropriate conditions, mismatch can prevent, or reduce polymerase extension (Prossner (1993) *Tibtech* 11:238). In addition it may be desirable to introduce a novel restriction site in the region of the mutation to create cleavage-based detection (Gasparini et al. (1992) *Mol. Cell Probes* 6:1). It is anticipated that in certain embodiments amplification may also be performed using Taq ligase for amplification (Barany (1991) *Proc. Natl. Acad. Sci USA* 88:189). In such cases, ligation will occur only if there is a perfect match at the 3' end of the 5' sequence making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving an OAT gene.

Furthermore, any cell type or tissue in which OAT is expressed may be utilized in the prognostic assays described herein.

Monitoring of Effects During Clinical Trials

Monitoring the influence of agents (e.g., drugs) on the expression or activity of an OAT protein (e.g., the modulation of gene expression, and or cell growth and differentiation mechanisms) can be applied not only in basic drug screening, but also in clinical trials. For example, the effectiveness of an agent determined by a screening assay as described herein to increase OAT gene expression, protein levels, or upregulate OAT activity, can be monitored in clinical trials of subjects exhibiting decreased OAT gene expression, protein levels, or downregulated OAT activity. Alternatively, the effectiveness of an agent determined by a screening assay to decrease OAT gene expression, protein levels, or downregulate OAT activity, can be monitored in clinical trials of subjects exhibiting increased OAT gene expression, protein levels, or upregulated OAT activity. In such clinical trials, the expression or activity of an OAT gene, and preferably, other genes that have been implicated in, for example, an OAT-associated disorder can be used as a "read out" or markers of the phenotype of a particular cell.

For example, and not by way of limitation, genes, including OAT, that are modulated in cells by treatment with an agent (e.g., compound, drug or small molecule) which modulates OAT activity (e.g., identified in a screening assay as described herein) can be identified. Thus, to study the effect of agents on OAT-associated disorders (e.g., disorders characterized by deregulated organic anion transport, gene expression, and/or cell growth and differentiation mechanisms), for example, in a clinical trial, cells can be isolated and RNA prepared and analyzed for the levels of expression of OAT and other genes implicated in the OAT-associated disorder, respectively. The levels of gene expression (e.g., a gene expression pattern) can be quantified by northern blot analysis or RT-PCR, as described herein, or alternatively by measuring the amount of protein produced, by one of the methods as described herein, or by measuring the levels of activity of OAT or other genes. In this way, the gene expression pattern can serve as a marker, indicative of the physiological response of the cells to the agent. Accordingly, this response state may be determined before, and at various points during treatment of the individual with the agent.

In a preferred embodiment, the present invention provides a method for monitoring the effectiveness of treatment of a subject with an agent (e.g., an agonist, antagonist, peptidomimetic, protein, peptide, nucleic acid, small molecule, or other drug candidate identified by the screening assays described herein) including the steps of (i) obtaining a pre-administration sample from a subject prior to administration of the agent; (ii) detecting the level of expression of an OAT protein, mRNA, or genomic DNA in the preadministration sample; (iii) obtaining one or more post-administration samples from the subject; (iv) detecting the level of expression or activity of the OAT protein, mRNA, or genomic DNA in the post-administration samples; (v) comparing the level of expression or activity of the OAT protein, rRNA, or genomic DNA in the pre-administration sample with the OAT protein, mRNA, or genomic DNA in the post administration sample or samples; and (vi) altering the administration of the agent to the subject accordingly. For example, increased administration of the agent may be desirable to increase the expression or activity of OAT to higher levels than detected, i.e., to increase the effectiveness of the agent. Alternatively, decreased administration of the agent may be desirable to decrease expression or activity of OAT to lower levels than detected, i.e., to decrease the effectiveness of the agent. According to such an embodiment, OAT expression or activity may be used as an indicator of the effectiveness of an agent, even in the absence of an observable phenotypic response.

Methods of Treatment:

The present invention provides for both prophylactic and therapeutic methods of treating a subject at risk of (or susceptible to) a disorder or having an OAT-associated disorder, e.g., a disorder associated with aberrant or unwanted OAT expression or activity. As used herein, "treatment" of a subject includes the application or administration of a therapeutic agent to a subject, or application or administration of a therapeutic agent to a cell or tissue from a subject, who has a diseases or disorder, has a symptom of a disease or disorder, or is at risk of (or susceptible to) a disease or disorder, with the purpose to cure, heal, alleviate, relieve, alter, remedy, ameliorate, improve, or affect the disease or disorder, the symptom of the disease or disorder, or the risk of (or susceptibility to) the disease or disorder. As used herein, a "therapeutic agent" includes, but is not limited to, small molecules, peptides, polypeptides, antibodies, ribozymes, and antisense oligonucleotides.

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the OAT molecules of the present invention or OAT modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Prophylactic Methods

In one aspect, the invention provides a method for preventing in a subject, a disease or condition associated with an aberrant or unwanted OAT expression or activity, by administering to the subject an OAT or an agent which modulates OAT expression or at least one OAT activity. Subjects at risk for a disease which is caused or contributed to by aberrant or unwanted OAT expression or activity can be identified by, for example, any or a combination of diagnostic or prognostic assays as described herein. Administration of a prophylactic agent can occur prior to the manifestation of symptoms characteristic of the OAT aberrancy, such that a disease or disorder is prevented or, alternatively, delayed in its progression. Depending on the type of OAT aberrancy, for example, an OAT, OAT agonist or OAT antagonist agent can be used for treating the subject. The appropriate agent can be determined based on screening assays described herein.

Therapeutic Methods

Another aspect of the invention pertains to methods of modulating OAT expression or activity for therapeutic purposes. Accordingly, in an exemplary embodiment, the modulatory method of the invention involves contacting a cell capable of expressing OAT with an agent that modulates one or more of the activities of OAT protein activity associated with the cell, such that OAT activity in the cell is modulated. An agent that modulates OAT protein activity can be an agent as described herein, such as a nucleic acid or a protein, a naturally-occurring target molecule of an OAT protein (e.g., an OAT substrate), an OAT antibody, an OAT agonist or antagonist, a peptidomimetic of an OAT agonist or antagonist, or other small molecule. In one embodiment, the agent stimulates one or more OAT activities. Examples of such stimulatory agents include active OAT protein and a nucleic acid molecule encoding OAT that has been introduced into the cell. In another embodiment, the agent inhibits one or more OAT activities. Examples of such inhibitory agents include antisense OAT nucleic acid molecules, anti-OAT antibodies, and OAT inhibitors. These modulatory methods can be performed in vitro (e.g., by culturing the cell with the agent) or, alternatively, in vivo (e.g., by administering the agent to a subject). As such, the present invention provides methods of treating an individual afflicted with a disease or disorder characterized by aberrant or unwanted expression or activity of an OAT protein or nucleic acid molecule. In one embodiment, the method involves administering an agent (e.g., an agent identified by a screening assay described herein), or combination of agents that modulates (e.g., upregulates or downregulates) OAT expression or activity. In another embodiment, the method involves administering an OAT protein or nucleic acid molecule as therapy to compensate for reduced, aberrant, or unwanted OAT expression or activity.

Stimulation of OAT activity is desirable in situations in which OAT is abnormally downregulated and/or in which increased OAT activity is likely to have a beneficial effect. For example, stimulation of OAT activity is desirable in situations in which an OAT is downregulated and/or in which increased OAT activity is likely to have a beneficial effect. Likewise, inhibition of OAT activity is desirable in situations in which OAT is abnormally upregulated and/or in which decreased OAT activity is likely to have a beneficial effect.

Pharmacogenomics

The OAT molecules of the present invention, as well as agents, or modulators which have a stimulatory or inhibitory effect on OAT activity (e.g., OAT gene expression) as identified by a screening assay described herein can be administered to individuals to treat (prophylactically or therapeutically) OAT-associated disorders (e.g., disorders characterized by aberrant organic anion transport, and/or gene expression, CNS, cardiac, musculoskeletal, metabolic, cell proliferation and/or differentiation disorders) associated with aberrant or unwanted OAT activity. In conjunction with such treatment, pharmacogenomics (i.e., the study of the relationship between an individual's genotype and that individual's response to a foreign compound or drug) may be considered. Differences in metabolism of therapeutics can lead to severe toxicity or therapeutic failure by altering the relation between dose and blood concentration of the pharmacologically active drug. Thus, a physician or clinician may consider applying knowledge obtained in relevant pharmacogenomics studies in determining whether to administer an OAT molecule or OAT modulator as well as tailoring the dosage and/or therapeutic regimen of treatment with an OAT molecule or OAT modulator.

Pharmacogenomics deals with clinically significant hereditary variations in the response to drugs due to altered drug disposition and abnormal action in affected persons. See, for example, Eichelbaum, M. et al. (1996) *Clin. Exp. Pharmacol. Physiol.* 23(10–11):983–985 and Linder, M. W. et al. (1997) *Clin. Chem.* 43(2):254–266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare genetic defects or as naturally-occurring polymorphisms. For example, glucose-6-phosphate organic anion transporter deficiency (G6PD) is a common inherited enzymopathy in which the main clinical complication is haemolysis after ingestion of oxidant drugs (anti-malarials, sulfonamides, analgesics, nitrofurans) and consumption of fava beans.

One pharmacogenomics approach to identifying genes that predict drug response, known as "a genome-wide association", relies primarily on a high-resolution map of the human genome consisting of already known gene-related markers (e.g., a "bi-allelic" gene marker map which consists of 60,000–100,000 polymorphic or variable sites on the human genome, each of which has two variants). Such a high-resolution genetic map can be compared to a map of the genome of each of a statistically significant number of patients taking part in a Phase II/III drug trial to identify markers associated with a particular observed drug response or side effect. Alternatively, such a high resolution map can be generated from a combination of some ten-million known single nucleotide polymorphisms (SNPs) in the human genome. As used herein, a "SNP" is a common alteration that occurs in a single nucleotide base in a stretch of DNA. For example, a SNP may occur once per every 1000 bases of DNA. A SNP may be involved in a disease process, however, the vast majority may not be disease-associated. Given a genetic map based on the occurrence of such SNPs, individuals can be grouped into genetic categories depending on a particular pattern of SNPs in their individual genome. In such a manner, treatment regimens can be tailored to groups of genetically similar individuals, taking into account traits that may be common among such genetically similar individuals.

Alternatively, a method termed the "candidate gene approach" can be utilized to identify genes that predict drug response. According to this method, if a gene that encodes a drug's target is known (e.g., an OAT protein of the present invention), all common variants of that gene can be fairly easily identified in the population and it can be determined if having one version of the gene versus another is associated with a particular drug response.

As an illustrative embodiment, the activity of drug metabolizing enzymes is a major determinant of both the intensity and duration of drug action. The discovery of genetic polymorphisms of drug metabolizing enzymes (e.g., N-organic anion transporter 2 (NAT 2) and cytochrome P450 enzymes CYP2D6 and CYP2C 19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Alternatively, a method termed the "gene expression profiling", can be utilized to identify genes that predict drug response. For example, the gene expression of an animal dosed with a drug (e.g., an OAT molecule or OAT modulator of the present invention) can give an indication whether gene pathways related to toxicity have been turned on.

Information generated from more than one of the above pharmacogenomics approaches can be used to determine appropriate dosage and treatment regimens for prophylactic or therapeutic treatment an individual. This knowledge, when applied to dosing or drug selection, can avoid adverse reactions or therapeutic failure and thus enhance therapeutic or prophylactic efficiency when treating a subject with an OAT molecule or OAT modulator, such as a modulator identified by one of the exemplary screening assays described herein.

Use of OAT Molecules as Surrogate Markers

The OAT molecules of the invention are also useful as markers of disorders or disease states, as markers for precursors of disease states, as markers for predisposition of disease states, as markers of drug activity, or as markers of the pharmacogenomic profile of a subject. Using the methods described herein, the presence, absence and/or quantity of the OAT molecules of the invention may be detected, and may be correlated with one or more biological states in vivo. For example, the OAT molecules of the invention may serve as surrogate markers for one or more disorders or disease states or for conditions leading up to disease states. As used herein, a "surrogate marker" is an objective biochemical marker which correlates with the absence or presence of a disease or disorder, or with the progression of a disease or disorder (e.g., with the presence or absence of a tumor). The presence or quantity of such markers is independent of the disease. Therefore, these markers may serve to indicate whether a particular course of treatment is effective in lessening a disease state or disorder. Surrogate markers are of particular use when the presence or extent of a disease state or disorder is difficult to assess through standard methodologies (e.g., early stage tumors), or when an assessment of disease progression is desired before a potentially dangerous clinical endpoint is reached (e.g., an assessment of cardiovascular disease may be made using cholesterol levels as a surrogate marker, and an analysis of HIV infection may be made using HIV RNA levels as a surrogate marker, well in advance of the undesirable clinical outcomes of myocardial infarction or fully-developed AIDS). Examples of the use of surrogate markers in the art include:

Koomen et al. (2000) *J. Mass. Spectrom.* 35:258–264; and James (1994) *AIDS Treatment News Archive* 209.

The OAT molecules of the invention are also useful as pharmacodynamic markers. As used herein, a "pharmacodynamic marker" is an objective biochemical marker which correlates specifically with drug effects. The presence or quantity of a pharmacodynamic marker is not related to the disease state or disorder for which the drug is being administered; therefore, the presence or quantity of the marker is indicative of the presence or activity of the drug in a subject. For example, a pharmacodynamic marker may be indicative of the concentration of the drug in a biological tissue, in that the marker is either expressed or transcribed or not expressed or transcribed in that tissue in relationship to the level of the drug. In this fashion, the distribution or uptake of the drug may be monitored by the pharmacodynamic marker. Similarly, the presence or quantity of the pharmacodynamic marker may be related to the presence or quantity of the metabolic product of a drug, such that the presence or quantity of the marker is indicative of the relative breakdown rate of the drug in vivo. Pharmacodynamic markers are of particular use in increasing the sensitivity of detection of drug effects, particularly when the drug is administered in low doses. Since even a small amount of a drug may be sufficient to activate multiple rounds of marker (e.g., an OAT marker) transcription or expression, the amplified marker may be in a quantity which is more readily detectable than the drug itself. Also, the marker may be more easily detected due to the nature of the marker itself; for example, using the methods described herein, anti-OAT antibodies may be employed in an immune-based detection system for an OAT protein marker, or OAT-specific radiolabeled probes may be used to detect an OAT mRNA marker. Furthermore, the use of a pharmacodynamic marker may offer mechanism-based prediction of risk due to drug treatment beyond the range of possible direct observations. Examples of the use of pharmacodynamic markers in the art include: Matsuda et al., U.S. Pat. No. 6,033,862; Hattis et al. (1991) *Env. Health Perspect.* 90:229–238; Schentag (1999) *Am. J. Health-Syst. Pharm.* 56 Suppl. 3:S21–S24; and Nicolau (1999) *Am. J. Health-Syst. Pharm.* 56 Suppl. 3:S16–S20.

The OAT molecules of the invention are also useful as pharmacogenomic markers. As used herein, a "pharmacogenomic marker" is an objective biochemical marker which correlates with a specific clinical drug response or susceptibility in a subject (see, e.g., McLeod et al. (1999) *Eur. J. Cancer* 35(12): 1650–1652). The presence or quantity of the pharmacogenomic marker is related to the predicted response of the subject to a specific drug or class of drugs prior to administration of the drug. By assessing the presence or quantity of one or more pharmacogenomic markers in a subject, a drug therapy which is most appropriate for the subject, or which is predicted to have a greater degree of success, may be selected. For example, based on the presence or quantity of RNA, or protein (e.g., OAT protein or RNA) for specific tumor markers in a subject, a drug or course of treatment may be selected that is optimized for the treatment of the specific tumor likely to be present in the subject. Similarly, the presence or absence of a specific sequence mutation in OAT DNA may correlate OAT drug response. The use of pharmacogenomic markers therefore permits the application of the most appropriate treatment for each subject without having to administer the therapy.

Electronic Apparatus Readable Media and Arrays

Electronic apparatus readable media comprising OAT sequence information is also provided. As used herein, "OAT sequence information" refers to any nucleotide and/or amino acid sequence information particular to the OAT molecules of the present invention, including but not limited to full-length nucleotide and/or amino acid sequences, partial nucleotide and/or amino acid sequences, polymorphic sequences including single nucleotide polymorphisms (SNPs), epitope sequences, and the like. Moreover, information "related to" said OAT sequence information includes detection of the presence or absence of a sequence (e.g., detection of expression of a sequence, fragment, polymorphism, etc.), determination of the level of a sequence (e.g., detection of a level of expression, for example, a quantitative detection), detection of a reactivity to a sequence (e.g., detection of protein expression and/or levels, for example, using a sequence-specific antibody), and the like. As used herein, "electronic apparatus readable media" refers to any suitable medium for storing, holding, or containing data or information that can be read and accessed directly by an electronic apparatus. Such media can include, but are not limited to: magnetic storage media, such as floppy discs, hard disc storage medium, and magnetic tape; optical storage media such as compact discs; electronic storage media such as RAM, ROM, EPROM, EEPROM and the like; and general hard disks and hybrids of these categories such as magnetic/optical storage media. The medium is adapted or configured for having recorded thereon OAT sequence information of the present invention.

As used herein, the term "electronic apparatus" is intended to include any suitable computing or processing apparatus or other device configured or adapted for storing data or information. Examples of electronic apparatus suitable for use with the present invention include stand-alone computing apparatuses; networks, including a local area network (LAN), a wide area network (WAN) Internet, Intranet, and Extranet; electronic appliances such as a personal digital assistants (PDAs), cellular phone, pager and the like; and local and distributed processing systems.

As used herein, "recorded" refers to a process for storing or encoding information on the electronic apparatus readable medium. Those skilled in the art can readily adopt any of the presently known methods for recording information on known media to generate manufactures comprising the OAT sequence information.

A variety of software programs and formats can be used to store the sequence information on the electronic apparatus readable medium. For example, the sequence information can be represented in a word processing text file, formatted in commercially-available software such as WordPerfect and Microsoft Word, represented in the form of an ASCII file, or stored in a database application, such as DB2, Sybase, Oracle, or the like, as well as in other forms. Any number of dataprocessor structuring formats (e.g., text file or database) may be employed in order to obtain or create a medium having recorded thereon the OAT sequence information.

By providing OAT sequence information in readable form, one can routinely access the sequence information for a variety of purposes. For example, one skilled in the art can use the sequence information in readable form to compare a target sequence or target structural motif with the sequence information stored within the data storage means. Search means are used to identify fragments or regions of the sequences of the invention which match a particular target sequence or target motif.

The present invention therefore provides a medium for holding instructions for performing a method for determining whether a subject has a OAT associated disease or disorder or a pre-disposition to a OAT associated disease or disorder, wherein the method comprises the steps of determining OAT sequence information associated with the subject and based on the OAT sequence information, determining whether the subject has a OAT associated disease or disorder or a pre-disposition to a OAT associated disease or disorder, and/or recommending a particular treatment for the disease, disorder, or pre-disease condition.

The present invention further provides in an electronic system and/or in a network, a method for determining whether a subject has a OAT associated disease or disorder or a pre-disposition to a disease associated with OAT wherein the method comprises the steps of determining OAT sequence information associated with the subject, and based on the OAT sequence information, determining whether the subject has a OAT associated disease or disorder or a pre-disposition to a OAT associated disease or disorder, and/or recommending a particular treatment for the disease, disorder or pre-disease condition. The method may further comprise the step of receiving phenotypic information associated with the subject and/or acquiring from a network phenotypic information associated with the subject.

The present invention also provides in a network, a method for determining whether a subject has a OAT associated disease or disorder or a pre-disposition to a OAT associated disease or disorder associated with OAT, said method comprising the steps of receiving OAT sequence information from the subject and/or information related thereto, receiving phenotypic information associated with the subject, acquiring information from the network corresponding to OAT and/or a OAT associated disease or disorder, and based on one or more of the phenotypic information, the OAT information (e.g., sequence information and/or information related thereto), and the acquired information, determining whether the subject has a OAT associated disease or disorder or a pre-disposition to a OAT associated disease or disorder. The method may further comprise the step of recommending a particular treatment for the disease, disorder or pre-disease condition.

The present invention also provides a business method for determining whether a subject has a OAT associated disease or disorder or a pre-disposition to a OAT associated disease or disorder, said method comprising the steps of receiving information related to OAT (e.g., sequence information and/or information related thereto), receiving phenotypic information associated with the subject, acquiring information from the network related to OAT and/or related to a OAT associated disease or disorder, and based on one or more of the phenotypic information, the OAT information, and the acquired information, determining whether the subject has a OAT associated disease or disorder or a pre-disposition to a OAT associated disease or disorder. The method may further comprise the step of recommending a particular treatment for the disease, disorder or pre-disease condition.

The invention also includes an array comprising a OAT sequence of the present invention. The array can be used to assay expression of one or more genes in the array. In one embodiment, the array can be used to assay gene expression in a tissue to ascertain tissue specificity of genes in the array. In this manner, up to about 7600 genes can be simultaneously assayed for expression, one of which can be OAT. This allows a profile to be developed showing a battery of genes specifically expressed in one or more tissues.

In addition to such qualitative determination, the invention allows the quantitation of gene expression. Thus, not only tissue specificity, but also the level of expression of a battery of genes in the tissue is ascertainable. Thus, genes can be grouped on the basis of their tissue expression per se and level of expression in that tissue. This is useful, for example, in ascertaining the relationship of gene expression between or among tissues. Thus, one tissue can be perturbed and the effect on gene expression in a second tissue can be determined. In this context, the effect of one cell type on another cell type in response to a biological stimulus can be determined. Such a determination is useful, for example, to know the effect of cell—cell interaction at the level of gene expression. If an agent is administered therapeutically to treat one cell type but has an undesirable effect on another cell type, the invention provides an assay to determine the molecular basis of the undesirable effect and thus provides the opportunity to co-administer a counteracting agent or otherwise treat the undesired effect. Similarly, even within a single cell type, undesirable biological effects can be determined at the molecular level. Thus, the effects of an agent on expression of other than the target gene can be ascertained and counteracted.

In another embodiment, the array can be used to monitor the time course of expression of one or more genes in the array. This can occur in various biological contexts, as disclosed herein, for example development of a OAT associated disease or disorder, progression of OAT associated disease or disorder, and processes, such a cellular transformation associated with the OAT associated disease or disorder.

The array is also useful for ascertaining the effect of the expression of a gene on the expression of other genes in the same cell or in different cells (e.g., ascertaining the effect of OAT expression on the expression of other genes). This provides, for example, for a selection of alternate molecular targets for therapeutic intervention if the ultimate or downstream target cannot be regulated.

The array is also useful for ascertaining differential expression patterns of one or more genes in normal and abnormal cells. This provides a battery of genes (e.g., including OAT) that could serve as a molecular target for diagnosis or therapeutic intervention.

This invention is further illustrated by the following examples which should not be construed as limiting. The contents of all references, patents and published patent applications cited throughout this application, as well as the Figures and the Sequence Listing, are incorporated herein by reference.

EXAMPLES

Example 1

Identification and Characterization of Human Oat cDNA

In this example, the identification and characterization of the genes encoding human OAT4 (clone Fbh57312) and human OAT5 (clone Fbh53659) is described.

Isolation of the human OAT cDNA

The invention is based, at least in part, on the discovery of genes encoding novel members of the organic anion transporter family. The entire sequence of human clone Fbh57312 was determined and found to contain an open reading frame termed human "OAT4". The entire sequence of human clone Fbh53659 was determined and found to contain an open reading frame termed human "OAT5".

The nucleotide sequence encoding the human OAT4 is shown in FIGS. 1A–B and is set forth as SEQ ID NO:4. The protein encoded by this nucleic acid comprises about 550 amino acids and has the amino acid sequence shown in FIGS. 1A–B and set forth as SEQ ID NO:5. The coding region (open reading frame) of SEQ ID NO:4 is set forth as SEQ ID NO:6.

The nucleotide sequence encoding the human OAT5 is shown in FIG. 6 and is set forth as SEQ ID NO:7. The protein encoded by this nucleic acid comprises about 724 amino acids and has the amino acid sequence shown in FIGS. 2A–B and set forth as SEQ ID NO:8. The coding region (open reading frame) is shown in FIGS. 2A–B and is set forth as SEQ ID NO:9.

Analysis of the human OAT Molecules

The amino acid sequences of human OAT4 and OAT5 were analyzed using the program PSORT (available online) to predict the localization of the proteins within the cell. This program assesses the presence of different targeting and localization amino acid sequences within the query sequence. The results of the analyses show that human OAT4 may be localized to the endoplasmic reticulum, the nucleus, or the mitochondria. The results of the analyses further show that human OAT 5 may be localized to the endoplasmic reticulum, vacuoles, secretory vesicles, or the mitochondria.

Additionally, searches of the amino acid sequences of human OAT4 and OAT5 were performed against the Memsat database. These searches resulted in the identification of 12 transmembrane domains in the amino acid sequence of human OAT4 at residues 1–31, 148–165, 172–195, 202–219, 228–252, 260–276, 347–365,375–399, 406422, 431451, 466–484, and 495–512 of SEQ ID NO:5 (FIG. 7). These searches further resulted in the identification of 12 transmembrane domains in the amino acid sequence of human OAT5 at residues 106–130, 143–166, 174–191, 230–254, 265–284, 314–335, 382405, 419–443, 456–473, 579–603, 613–636, and 667–690 of SEQ ID NO:8 (FIG. 8).

Searches of the amino acid sequences of human OAT4 and OAT5 were also performed against the HMM database. These searches resulted in the identification of a "sugar (and other) transporter domain" at about residues 103–527 (score=34.7) of SEQ ID NO:5 (FIG. 3). These searches further resulted in the identification of a "sugar (and other) transporter domain" at about residues 141–555 of SEQ ID NO:8 (FIGS. 4A–B).

Searches of the amino acid sequence of human OAT were further performed against the Prosite database. These searches resulted in the identification of two ATP/GTP-binding site motif A (P-loop) domains in the amino acid sequence of human OAT5 at about residues 343–350 and 360–367 of SEQ ID NO:8. These searches also resulted in the identification of a number of potential N-glycosylation sites, protein kinase C phosphorylation sites, casein kinase II phosphorylation sites, N-myristoylation sites, amidation sites, and leucine zipper patterns in the amino acid sequence of human OAT4. These searches further resulted in the identification in the amino acid sequence of human OAT5 of a potential cAMP-and cGMP-dependent protein kinase phosphorylation site and an number of potential N-glycosylation sites, protein kinase C phosphorylation sites, casein kinase II phosphorylation sites, and N-myristoylation sites.

Tissue Distribution of OAT mRNA

This example describes the tissue distribution of human OAT mRNA, as may be determined using in situ hybridization analysis. For in situ analysis, various tissues, e.g., tissues obtained from brain, are first frozen on dry ice. Ten-micrometer-thick sections of the tissues are postfixed with 4% formaldehyde in DEPC-treated 1× phosphate-buffered saline at room temperature for 10 minutes before being rinsed twice in DEPC 1× phosphate-buffered saline and once in 0.1 M triethanolamine-HCl (pH 8.0). Following incubation in 0.25% acetic anhydride-0.1 M triethanolamine-HCl for 10 minutes, sections are rinsed in DEPC 2×SSC (1×SSC is 0.15 M NaCl plus 0.015 M sodium citrate). Tissue is then dehydrated through a series of ethanol washes, incubated in 100% chloroform for 5 minutes, and then rinsed in 100% ethanol for 1 minute and 95% ethanol for 1 minute and allowed to air dry.

Hybridizations are performed with $^{35}$S-radiolabeled ($5\times10^7$ cpm/ml) cRNA probes. Probes are incubated in the presence of a solution containing 600 mM NaCl, 10 mM Tris (pH 7.5), 1 mM EDTA, 0.01% sheared salmon sperm DNA, 0.01% yeast tRNA, 0.05% yeast total RNA type X1, 1× Denhardt's solution, 50% formamide, 10% dextran sulfate, 100 mM dithiothreitol, 0.1% sodium dodecyl sulfate (SDS), and 0.1% sodium thiosulfate for 18 hours at 55° C.

After hybridization, slides are washed with 2×SSC. Sections are then sequentially incubated at 37° C. in TNE (a solution containing 10 mM Tris-HCl (pH 7.6), 500 mM NaCl, and 1 mM EDTA), for 10 minutes, in TNE with 10 μg of RNase A per ml for 30 minutes, and finally in TNE for 10 minutes. Slides are then rinsed with 2×SSC at room temperature, washed with 2×SSC at 50° C. for 1 hour, washed with 0.2×SSC at 55° C. for 1 hour, and 0.2×SSC at 60° C. for 1 hour. Sections are then dehydrated rapidly through serial ethanol-0.3 M sodium acetate concentrations before being air dried and exposed to Kodak Biomax MR scientific imaging film for 24 hours and subsequently dipped in NB-2 photoemulsion and exposed at 4° C. for 7 days before being developed and counter stained.

Analysis of Human OAT Expression using the Taqman Procedure

The Taqman™ procedure is a quantitative, real-time PCR-based approach to detecting mRNA. The RT-PCR reaction exploits the 5' nuclease activity of AmpliTaq Gold™ DNA Polymerase to cleave a TaqMan™ probe during PCR. Briefly, cDNA was generated from the samples of interest and served as the starting material for PCR amplification. In addition to the 5' and 3' gene-specific primers, a gene-specific oligonucleotide probe (complementary to the region being amplified) was included in the reaction (i.e., the Taqman™ probe). The TaqMan™ probe included an oligonucleotide with a fluorescent reporter dye covalently linked to the 5' end of the probe (such as FAM (6-carboxyfluorescein), TET (6-carboxy-4,7,2',7'-tetrachlorofluorescein), JOE (6-carboxy-4,5-dichloro-2,7-dimethoxyfluorescein), or VIC) and a quencher dye (TAMRA (6-carboxy-N,N,N',N'-tetramethylrhodamine) at the 3' end of the probe.

During the PCR reaction, cleavage of the probe separated the reporter dye and the quencher dye, resulting in increased fluorescence of the reporter. Accumulation of PCR products was detected directly by monitoring the increase in fluorescence of the reporter dye. When the probe was intact, the proximity of the reporter dye to the quencher dye resulted in suppression of the reporter fluorescence. During PCR, if the target of interest was present, the probe specifically annealed between the forward and reverse primer sites. The 5'–3' nucleolytic activity of the AmpliTaq™ Gold DNA Polymerase cleaved the probe between the reporter and the quencher only if the probe hybridized to the target. The probe fragments were then displaced from the target, and polymerization of the strand continued. The 3' end of the probe was blocked to prevent extension of the probe during PCR. This process occurred in every cycle and did not interfere with the exponential accumulation of product. RNA was prepared using the trizol method and treated with DNase to remove contaminating genomic DNA. cDNA was synthesized using standard techniques. Mock cDNA synthesis in the absence of reverse transcriptase resulted in samples with no detectable PCR amplification of the control GAPDH or β-actin gene confirming efficient removal of genomic DNA contamination.

Figure 9:
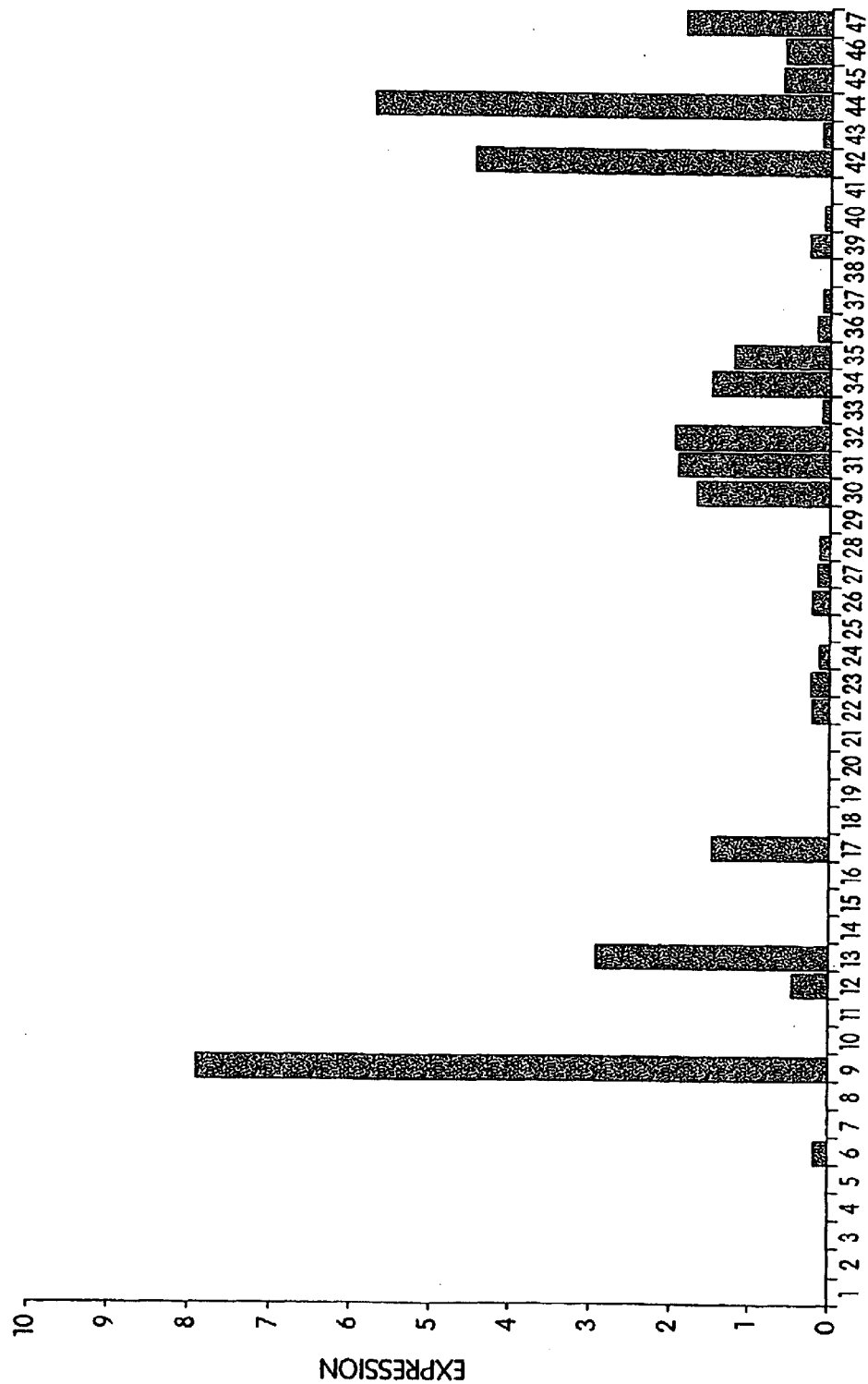
FIG. 9 depicts the expression levels of human OAT5 mRNA in various human cell types and tissues, as determined by Taqman analysis. Samples: (1) normal artery; (2) diseased aorta; (3) normal vein; (4) coronary smooth muscle cells; (5) human umbilical vein endothelial cells (HUVECs); (6) hemangioma; (7) normal heart; (8) heart—congestive heart failure (CHF); (9) kidney; (10) skeletal muscle; (11) normal adipose tissue; (12) pancreas; (13) primary osteoblasts; (14) differentiated osteoclasts; (15) normal skin; (16) normal spinal cord; (17) normal brain cortex; (18) brain—hypothalamus; (19) nerve; (20) dorsal root ganglion (DRG); (21) normal breast; (22) breast tumor; (23) normal ovary; (24) ovary tumor; (25) normal prostate; (26) prostate tumor; (27) salivary gland; (28) normal colon; (29) colon tumor; (30) normal lung; (31) lung tumor; (32) lung—chronic obstructive pulmonary disease (COPD); (33) colon—inflammatory bowel disease (IBD); (34) normal liver; (35) liver—fibrosis; (36) normal spleen; (37) normal tonsil; (38) normal lymph node; (39) normal small intestine; (40) macrophages; (41) synovium; (42) bone marrow mononuclear cells (BM-MNC); (43) activated peripheral blood mononuclear cells (PBMCs); (44) neutrophils; (45) megakaryocytes; (46) erythroid cells; (47) positive control.

Taqman analysis showed that human OAT5 was highly expressed in the kidney, primary osteoblasts, brain cortex, lung, liver, bone marrow mononuclear cells (BM-MNC), and neutrophils (see FIG. 9).

Example 2

Expression of Recombinant Oat Protein in Bacterial Cells

In this example, human OAT is expressed as a recombinant glutathione-S-transferase (GST) fusion polypeptide in E. coli and the fusion polypeptide is isolated and characterized. Specifically, human OAT is fused to GST and this fusion polypeptide is expressed in E. coli, e.g., strain PEB 199. Expression of the GST-OAT fusion protein in PEB 199 is induced with IPTG. The recombinant fusion polypeptide is purified from crude bacterial lysates of the induced PEB 199 strain by affinity chromatography on glutathione beads. Using polyacrylamide gel electrophoretic analysis of the polypeptide purified from the bacterial lysates, the molecular weight of the resultant fusion polypeptide is determined.

Example 3

Expression of Recombinant Oat Protein in COS Cells

To express the human OAT gene in COS cells, the pcDNA/Amp vector by Invitrogen Corporation (San Diego, Calif.) is used. This vector contains an SV40 origin of replication, an ampicillin resistance gene, an E. coli replication origin, a CMV promoter followed by a polylinker region, and an SV40 intron and polyadenylation site. A DNA fragment encoding the entire human OAT protein and an HA tag (Wilson et al. (1984) Cell 37:767) or a FLAG tag fused in-frame to its 3' end of the fragment is cloned into the polylinker region of the vector, thereby placing the expression of the recombinant protein under the control of the CMV promoter.

To construct the plasmid, the human OAT DNA sequence is amplified by PCR using two primers. The 5' primer contains the restriction site of interest followed by approximately twenty nucleotides of the human OAT coding sequence starting from the initiation codon; the 3' end sequence contains complementary sequences to the other restriction site of interest, a translation stop codon, the HA tag or FLAG tag and the last 20 nucleotides of the human OAT coding sequence. The PCR amplified fragment and the pCDNA/Amp vector are digested with the appropriate restriction enzymes and the vector is dephosphorylated using the CIAP enzyme (New England Biolabs, Beverly, Mass.). Preferably the two restriction sites chosen are different so that the human OAT gene is inserted in the correct orientation. The ligation mixture is transformed into E. coli cells (strains HB 101, DH5□, SURE, available from Stratagene Cloning Systems, La Jolla, Calif., can be used), the transformed culture is plated on ampicillin media plates, and resistant colonies are selected. Plasmid DNA is isolated from transformants and examined by restriction analysis for the presence of the correct fragment.

COS cells are subsequently transfected with the OAT-pcDNA/Amp plasmid DNA using the calcium phosphate or calcium chloride co-precipitation methods, DEAE-dextran-mediated transfection, lipofection, or electroporation. Other suitable methods for transfecting host cells can be found in Sambrook, J. et al., Molecular Cloning: A Laboratory Manual. 2nd, ed., Cold Spring Harbor Laboratory, Cold Spring Harbor Laboratory Press, Cold Spring Harbor, N.Y., 1989. The expression of the OAT polypeptide is detected by radiolabeling ($^{35}$S-methionine or $^{35}$S-cysteine available from NEN, Boston, Mass., can be used) and immunoprecipitation (Harlow, E. and Lane, D. Antibodies: A Laboratory Manual, Cold Spring Harbor Laboratory Press, Cold Spring Harbor, N.Y., 1988) using an HA specific monoclonal antibody. Briefly, the cells are labeled for 8 hours with $^{35}$S-methionine (or $^{35}$S-cysteine). The culture media are then collected and the cells are lysed using detergents (RIPA buffer, 150 mM NaCl, 1% NP-40, 0.1% SDS, 0.5% DOC, 50 mM Tris, pH 7.5). Both the cell lysate and the culture media are precipitated with an HA specific monoclonal antibody. Precipitated polypeptides are then analyzed by SDS-PAGE.

Alternatively, DNA containing the OAT coding sequence is cloned directly into the polylinker of the pCDNA/Amp vector using the appropriate restriction sites. The resulting plasmid is transfected into COS cells in the manner described above, and the expression of the OAT polypeptide is detected by radiolabeling and immunoprecipitation using an OAT-specific monoclonal antibody.

Equivalents

Those skilled in the art will recognize, or be able to ascertain using no more than routine experimentation, many equivalents to the specific embodiments of the invention described herein. Such equivalents are intended to be encompassed by the following claims.

SEQUENCE LISTING (99 sequences)

SEQ ID NO: 1 - DNA, 6768 bp, Homo sapiens
  CDS (165)..(6596)
cggcaagagctgcggagcccctggaagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccgctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctggggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtgaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcgctgctggttctggtgctcaagctgggggacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacagcggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtggtgggccccgagcaggaccgtctactgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctacggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggtcgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtgctggtgaaaaaaaaaaaaaaaaaaaaaaagg

SEQ ID NO: 2 - protein, 2144 aa, Homo sapiens
MAFWTQLMLLLWKNFMYRRRQPLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLLRTESLGLALGQAQEPLHSLLEAAGDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHSGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSRPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGPARHAHSITTLNHPLNLTKEQLSEAALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGSELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 3 - DNA, 6432 bp, Homo sapiens
  CDS (1)..(6432)
atggccttctggacacagctgatgctgctgctctggaagaatttcatgtatcgccggagacagccgctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctggggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtgaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcgctgctggttctggtgctcaagctgggggacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacagcggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtggtgggccccgagcaggaccgtctactgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctacggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgaggctgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctagccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctgggtcggagctgcgcgaggcacatggaggtcgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctc

SEQ ID NO: 4 - DNA, 2206 bp, Homo sapiens
  CDS (372)...(2021)
aattcccgggtcgacccacgcgtccgagaactcagaaggtggctcagccctctggtccacacttggtgggcagctcggatgccccaggcagcccgggcacagtgagcttagtccccttcaccccctccgcagagctctggggcatccgcacagtcactcctggacacaagataaggaggagtttccccgaggcatcacagggcttcccgggactgagggactgactcaactggttattggacagtgccccacccccaatccggctgrggggcaggaaggcagaaggtcttggtggccctggatcttgtggctgcaatcggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctcaatcagagcgtggaggcgagttgggcgacttcaagggcctggcatggcagagccagcagccgtggcgagtggacagcgtggccgtctgctgtggctgaagcagcttcacagtacttctctt

SEQ ID NO: 5 - protein, 550 aa, Homo sapiens
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLQSLGRDIFLLQALFGAVDFLGRATTALLLSFLGRRTIQAGSQAMAGLAILANMLVPQDLQTLRVVFAVLGKGCFGISLTCLTIYKAELFPTPVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 6 - DNA, 1650 bp, Homo sapiens
  CDS (1)...(1650)
atggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctc

SEQ ID NO: 7 - DNA, 2634 bp, Homo sapiens
  CDS (104)...(2275)
aagcttcccgcacgggggcgctgtcacctgcctgtgggaggagccagagagggacctggctctgctgctctgaagcaccggagtcgggagaacccatccagacatgaagagcgccaaaggtattgagaacttggcttttgtcccctccagcccagacatcctgcgccgcttgtctgcgtcgccctcccaaatcgaagtctctgccttgtcctctgacccccaaagagagaattctcagccacaggagcttcagaagccccaggagccccagaagtcaccagagccatctctgccttcagcccctcccagtgtctccgaagagaagctccggtcactgtcgctgtccgagtttgaggaggggtcttacggctggaggaacttccatcctcaatgtctccagcgctgcaacacacctggaggctttctgcttcactactgcctcttggccgtcacgcaaggtattgtagttaatggcctagtaaatattagcatttccactgttgagaagcgttatgaaatgaagagttccctgactggcctgatttcatcaagctacgatatttcattctgtttgttgtctttatttgtatcattctttggtgaaagaggacataagccgagatggcttgcatttgcagcctttatgattggactgggagcacttgtattctcattgccacaatttttcagtggagaatataaattggggtctctttttgaagacacttgtgtaacaacaaggaatagcaccagttgtacatcttcaacttcttcactttctaactacttgtatgtcttcatcttgggacaactattgctgggggcaggaggaactcctctttatactctgggaacagcctttcttgatgattctgtgcccacacacaagtcttctctctatataggaaccggttatgctatgtcaatcttaggccctgctattggctatgtattgggaggacaactgctaaccatatacattgatgttgctatgggagaaagcactgatgtcactgaggatgatccgcgatggttgggagcttggtggattgggtttcttctatcatggatctttgcttggtctttaataatacctttttcttgctttccaaaacatttaccaggtacagcagaaattcaagctggaaaaacttcccaggctcatcagagtaatagtaatgcagatgtgaaatttggaaaaagtattaaagattttccagctgctctaaagaatttgatgaagaatgctgtctttatgtgtttagttctatcaacttcttcagaagccttaattactactggatttgctacatttttacctaaatttatagaaaatcaattcggattgacatccagcttcgcagctactcttggaggggctgttttaattcctggagctgctctcggtcaaattttaggtggcttccttgtttcaaaattcagaatgacatgtaaaaacacaatgaagtttgcactgttcacatctggagttgcacttacgctgagttttgtatttatgtatgccaaatgtgaaaatgagccatttgctggtgtatctgaatcatataatgggactggagaattgggaaacttgatagccccttgtaatgccaattgtaactgttcgcgatcatattattatcctgtctgtggagatggagtccaatatttttctccctgctttgcaggctgttcaaacccagttgcacacaggaagccaaaggtatattacaactgttcctgtattgaaaggaaaacagaaataacatccactgcagaaacttttggttttgaagctaaagctggaaaatgtgaaactcattgtgcgaaactgcccatattcctttgcattttctttattgtaattatttttacctttatggccggtactcctataactgtgtctatcctaaggtgtgttaatcacagacaacggtccctagccttgggaatacaatttatggtccttcgattattagggacaattcctggaccaattatatttggtttcacaatagacagcacatgtattctttgggatataaatgattgtggaattaaaggagcttgctggatttatgataacatcaagatggcccatatgctagtagccataagtgttacttgtaaagttatcaccatgttcttcaatggatttgcaatctttttgtataaaccacctccatcagccacagatgtgtcatttcataaagagaatgcagttgtgactaatgttttagcagaacaggatctcaacaaaatagtaaaagaagggtgaaatgggaaaagagaagactgttttacacctggaaaatttacctcgatttttaagaacacacattgccatggcaggattatctatccaatatggacaatcatatttacaaaattgatgtttttataatcaaatgtatttttttacttatgtagtttttgttttatgcaagaaacagacctgtgccttcaaagcccacgtaaagcctcaaaacacagcacacacacacacgagcacacacacacacacacacacgaacacacacacacacacacacacgcacacatacacacttatttcctattcccattgtctaggtatgaaatcctcaagcaaaaaaaaaaaaaaagggcggccgc

SEQ ID NO: 8 - protein, 724 aa, Homo sapiens [sequence omitted]

SEQ ID NO: 9 - DNA, 2172 bp, Homo sapiens
  CDS (1)...(2172)
atgaagagcgccaaaggtattgagaacttggcttttgtcccctccagcccagacatcctgcgccgcttgtctgcgtcgccctcccaaatcgaagtctctgccttgtcctctgacccccaaagagagaattctcagccacaggagcttcagaagccccaggagccccagaagtcaccagagccatctctgccttcagcccctcccagtgtctccgaagagaagctccggtcactgtcgctgtccgagtttgaggaggggtcttacggctggaggaacttccatcctcaatgtctccagcgctgcaacacacctggaggctttctgcttcactactgcctcttggccgtcacgcaaggtattgtagttaatggcctagtaaatattagcatttccactgttgagaagcgttatgaaatgaagagttccctgactggcctgatttcatcaagctacgatatttcattctgtttgttgtctttatttgtatcattctttggtgaaagaggacataagccgagatggcttgcatttgcagcctttatgattggactgggagcacttgtattctcattgccacaatttttcagtggagaatataaattggggtctctttttgaagacacttgtgtaacaacaaggaatagcaccagttgtacatcttcaacttcttcactttctaactacttgtatgtcttcatcttgggacaactattgctgggggcaggaggaactcctctttatactctgggaacagcctttcttgatgattctgtgcccacacacaagtcttctctctatataggaaccggttatgctatgtcaatcttaggccctgctattggctatgtattgggaggacaactgctaaccatatacattgatgttgctatgggagaaagcactgatgtcactgaggatgatccgcgatggttgggagcttggtggattgggtttcttctatcatggatctttgcttggtctttaataatacctttttcttgctttccaaaacatttaccaggtacagcagaaattcaagctggaaaaacttcccaggctcatcagagtaatagtaatgcagatgtgaaatttggaaaaagtattaaagattttccagctgctctaaagaatttgatgaagaatgctgtctttatgtgtttagttctatcaacttcttcagaagccttaattactactggatttgctacatttttacctaaatttatagaaaatcaattcggattgacatccagcttcgcagctactcttggaggggctgttttaattcctggagctgctctcggtcaaattttaggtggcttccttgtttcaaaattcagaatgacatgtaaaaacacaatgaagtttgcactgttcacatctggagttgcacttacgctgagttttgtatttatgtatgccaaatgtgaaaatgagccatttgctggtgtatctgaatcatataatgggactggagaattgggaaacttgatagccccttgtaatgccaattgtaactgttcgcgatcatattattatcctgtctgtggagatggagtccaatatttttctccctgctttgcaggctgttcaaacccagttgcacacaggaagccaaaggtatattacaactgttcctgtattgaaaggaaaacagaaataacatccactgcagaaacttttggttttgaagctaaagctggaaaatgtgaaactcattgtgcgaaactgcccatattcctttgcattttctttattgtaattatttttacctttatggccggtactcctataactgtgtctatcctaaggtgtgttaatcacagacaacggtccctagccttgggaatacaatttatggtccttcgattattagggacaattcctggaccaattatatttggtttcacaatagacagcacatgtattctttgggatataaatgattgtggaattaaaggagcttgctggatttatgataacatcaagatggcccatatgctagtagccataagtgttacttgtaaagttatcaccatgttcttcaatggatttgcaatctttttgtataaaccacctccatcagccacagatgtgtcatttcataaagagaatgcagttgtgactaatgttttagcagaacaggatctcaacaaaatagtaaaagaaggg

SEQ ID NO: 10 - protein, 722 aa, Homo sapiens
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 11 - protein, 8 aa, Artificial sequence
  ATP/GTP-binding site motif A (P-loop) domain
  VARIANT 1: Xaa = Arg or Gly
  VARIANT 2, 3, 4, 5: Xaa may be any amino acid
  VARIANT 8: Xaa may be either Ser or Thr
XXXXXGKX

SEQ ID NO: 12 - DNA, 1917 bp, Homo sapiens
  CDS (13)...(1728)
gtccggcgaccgatggagcaggaggcgcgggtgctgagagctgcgggcggctttggccgggcccggcgcctgctggcctccgcctcgtgggtaccctgcatagtgctggggctggtgctgagctccgaggagctgcttaccgcgcagcccgcgccccactgccgaccggaccccacgctgttgcccccagcgctgcgcgccctgcgcggacccgcgctgctggacgccgccatcccgcgcctggggcccacgcgagccgcgagcccctgcctgctcctgcgctaccccgatcccgcgccctgcacccgccccggcccgcgccccgcgcccgcacgcaacggcacccggccctgcacacgcggctggctctacgcgctgcccggcgccggcctcctgcaaagcccggtcacccagtggaaccttgtgtgtggagacggctggaaggtcccgctggagcaggtgagccacctcctgggctggctgctgggctgtgtcatcctgggagcaggctgtgaccggtttggacgccgggcagtttttgtggcctccctggtgctgaccacaggcctgggggccagtgaggccctggctgccagcttccctaccctgctggtcctgcgcctactccacgggggcacattggcaggggccctcctcgccctgtatctggctcgcctggagttgtgtgaccctccccaccgcctggccttctccatgggggctggccttttctcggtggtgggcaccctgctgctgcccggcctggctgcgcttgtgcaggactggcgtcttctgcaggggctgggcgccctgatgagtggactcttgctgctcttttgggggttcccggccctgttccccgagtctccctgctggctgctggccacaggtcaggtagctcgagccaggaagatcctgtggcgctttgcagaagccagtggcgtggatcccggggacagtcccttggaggagaactccctggctacagagctgaccatgctgtctgcacggagcccccagccccggtaccactccccactggggcttctgcgtacccgagtcacctggagaaacgggcttatcttgggcttcagctcgctggttggtggaggcatcagagctagcttccgccgcagcctggcacctcaggtgccgaccttctacctgccctacttcctggaggccggcctggaggcggcagccttggtcttcctgctcctgacggcagattgctgtggacgccgccccgtgctgctgctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggggggccgggctgggcctggtgctgggggccgggttcctgggccaggcagccggccccctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgccccccactcctgcggggccgcccccgccaggaccacctgcctctgctgccgccctccaactcctactgggccggccacacccccgagcagcactagtcctgcctggtggccctgggagccaggatgggaccaaagtcaaggcctggggcatggctgagtaccccagacgtctggtccagggcagacacattcctctcagaagcccgtgtctcagtgcaggtggagccgtggggacagcgtgaaggtgtctccagccaggccccaggcactgggaggccctgg

SEQ ID NO: 13 - protein, 572 aa, Homo sapiens
MEQEARVLRAAGGFGRARRLLASASWVPCIVLGLVLSSEELLTAQPAPHCRPDPTLLPPALRALRGPALLDAAIPRLGPTRAASPCLLLRYPDPAPCTRPGPRPAPARNGTRPCTRGWLYALPGAGLLQSPVTQWNLVCGDGWKVPLEQVSHLLGWLLGCVILGAGCDRFGRRAVFVASLVLTTGLGASEALAASFPTLLVLRLLHGGTLAGALLALYLARLELCDPPHRLAFSMGAGLFSVVGTLLLPGLAALVQDWRLLQGLGALMSGLLLLFWGFPALFPESPCWLLATGQVARARKILWRFAEASGVDPGDSPLEENSLATELTMLSARSPQPRYHSPLGLLRTRVTWRNGLILGFSSLVGGGIRASFRRSLAPQVPTFYLPYFLEAGLEAAALVFLLLTADCCGRRPVLLLGTMVTGLASLLLLAGAQYLPGWTVLFLSVLGLLASRAVSALSSLFAAEVFPTVIRGAGLGLVLGAGFLGQAAGPLDTLHGRQGFFLQQVVFASLAVLALLCVLLLPESRSRGLPQSLQDADRLRRPPLLRGRPRQDHLPLLPPSNSYWAGHTPEQH

SEQ ID NO: 14 - DNA, 1716 bp, Homo sapiens
  CDS (1)...(1716)
atggagcaggaggcgcgggtgctgagagctgcgggcggctttggccgggcccggcgcctgctggcctccgcctcgtgggtaccctgcatagtgctggggctggtgctgagctccgaggagctgcttaccgcgcagcccgcgccccactgccgaccggaccccacgctgttgcccccagcgctgcgcgccctgcgcggacccgcgctgctggacgccgccatcccgcgcctggggcccacgcgagccgcgagcccctgcctgctcctgcgctaccccgatcccgcgccctgcacccgccccggcccgcgccccgcgcccgcacgcaacggcacccggccctgcacacgcggctggctctacgcgctgcccggcgccggcctcctgcaaagcccggtcacccagtggaaccttgtgtgtggagacggctggaaggtcccgctggagcaggtgagccacctcctgggctggctgctgggctgtgtcatcctgggagcaggctgtgaccggtttggacgccgggcagtttttgtggcctccctggtgctgaccacaggcctgggggccagtgaggccctggctgccagcttccctaccctgctggtcctgcgcctactccacgggggcacattggcaggggccctcctcgccctgtatctggctcgcctggagttgtgtgaccctccccaccgcctggccttctccatgggggctggccttttctcggtggtgggcaccctgctgctgcccggcctggctgcgcttgtgcaggactggcgtcttctgcaggggctgggcgccctgatgagtggactcttgctgctcttttgggggttcccggccctgttccccgagtctccctgctggctgctggccacaggtcaggtagctcgagccaggaagatcctgtggcgctttgcagaagccagtggcgtggatcccggggacagtcccttggaggagaactccctggctacagagctgaccatgctgtctgcacggagcccccagccccggtaccactccccactggggcttctgcgtacccgagtcacctggagaaacgggcttatcttgggcttcagctcgctggttggtggaggcatcagagctagcttccgccgcagcctggcacctcaggtgccgaccttctacctgccctacttcctggaggccggcctggaggcggcagccttggtcttcctgctcctgacggcagattgctgtggacgccgccccgtgctgctgctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggggggccgggctgggcctggtgctgggggccgggttcctgggccaggcagccggccccctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgccccccactcctgcggggccgcccccgccaggaccacctgcctctgctgccgccctccaactcctactgggccggccacacccccgagcagcac

SEQ ID NO: 15 - DNA, 1963 bp, Homo sapiens
  CDS (67)...(1491)
gtcgacccacgcgtccgggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccacggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggtgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgacaaaaaaaaaaaaaaaaaaaaaaaaaaaaaaagggcggccgc

SEQ ID NO: 16 - protein, 474 aa, Homo sapiens [sequence omitted]

SEQ ID NO: 17 - DNA, 1425 bp, Homo sapiens
  CDS (1)...(1425)
atggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccacggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggtgctgtgttagccttagtggccattttcataatgtctctaaacaagcgacactctagtggtgatgggaatagtaaattaaaaagtgagtag

SEQ ID NO: 18 - protein, 413 aa, Salmonella typhi
MNTNVYENTDSETITPLNKRRILPVFLLVGLYAASTAAVMSVLPFYIREMGGSPLIIGIIIATEAFSQFCAAPLIGHLSDRVGRKRILIVTLAIAAISLLLLANAQCILFILLARTLFGISAGNLSAAAAYIADCTHVRNRRQAIGILTGCIGLGGIVGAGVSGWLSRISLGAPIYAAFILVLGAALVAIWGLKDPSTTSRTTDKIASFSARAILKMPVLRVLIIVMLCHFFAYGMYSSQLPVFLSDTFIWNGLPFGPKALSYLLMADGVINIFVQLFLLGWVSQYFSERKLIILIFALLCTGFLTAGIATTIPVLIFAIVCISIADALAKPTYLAALSVHVSPARQGIVIGTAQALIAIADFISPVLGGFVLGYALYGVWIGIAISVAIIGLVTAMIYLSKSSPLIAKPETE

SEQ ID NO: 19 - DNA, 4693 bp, Homo sapiens
  CDS (171)...(3740)
aggccccgggggagcggggccgcagctgggggggcgggagcccgtggggagccgagccgagcgccccccgccccagcccccggcatgggcagtacggggccgccggggcgggcgccgagcgctgagcgctgagggtctcccatgggattgctgggatcttgctgggtgagatggcagtgtgtgcaaaaaagcgccccccagaagaagaaaggagggcgcgggctaatgaccgagaatacaatgagaaattccagtatgcgagtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatcctccagcaggagcagtggatgaatgtctgtgttggtgatattatcaagctagaaaataaccagtttgtggcggcggatctcctcctcctttccagcagtgagtcccatgggctgtgttacatagagacagcagaacttgatggcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtgatgtgtttgacgtcctgggacacaaagctgaattgggagagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggagagaggtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcatagtgcggaatccagaggggaagatccgactctactgcaaaggggctgacactatcctactggacagactgcaccactccactcaagagctgctcaacaccaccatggaccaccttaatgagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatgctgctgggtgcaacggccattgaggacaaacttcagcaaggggttccagagaccattgccctcctgacactggccaacatcaagatttgggtgctaaccggagacaagcaagagacggctgtgaacatcggctattcctgcaagatgctgacggatgacatgactgaggttttcatagtcactggccatactgtcctggaggtgcgggaggagctcaggaaagcccgggagaagatgatggactcatcccgctctgtaggcaacggcttcacctatcaggacaagctttcttcttccaagctaacttctgtcctggaggccgttgctggggagtacgccctggtcataaatggtcacagcctggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaacggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccagaccgtctatgaccagtatttcatcaccctgtataacatcgtgtacacctccctgccagtcctggctatgggggtctttgatcaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggtgtttgctgatgccacccgggatgatggcactcagctggctgactaccagtcctttgcagtcactgtggccacatccttggtcattgtggttagcgtgcagattgggctcgacacaggctactggacggccatcaaccacttcttcatctggggaagccttgctgtttactttgccatcctctttgccatgcacagcaatgggctcttcgacatgtttcccaaccagttccggtttgtggggaatgcccagaacaccttggcccagcccacggtgtggctgaccattgtgctcaccacggtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggacagaagtggaaccaaaaacaagaaaaaactgtgagagattgtgtctgccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttctttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttcttttt

SEQ ID NO: 20 - protein, 1190 aa, Homo sapiens
MAVCAKKRPPEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSESHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVSVEVIRLGHSYFINWDKKMFCMKKRTPAEARTTTLNEELGQVEYIFSDKTGTLTQNIMVFNKCSINGHSYGDVFDVLGHKAELGERPEPVDFSFNPLADKKFLFWDPSLLEAVKIGDPHTHEFFRLLSLCHTVMSEEKNEGERYYKAQSPDEGALVTAARNFGFVFRSRTPKTITVHEMGTAITYQLLAILDFNNIRKRMSVIVRNPEGKIRLYCKGADTILLDRLHHSTQELLNTTMDHLNEYAGEGLRTLVLAYKDLDEEYYEEWAERRLQASLAQDSREDRLASIYEEVENNMMLLGATAIEDKLQQGVPETIALLTLANIKIWVLTGDKQETAVNIGYSCKMLTDDMTEVFIVTGHTVLEVREELRKAREKMMDSSRSVGNGFTYQDKLSSSKLTSVLEAVAGEYALVINGHSLAHALEADMELEFLETACACKAVICCRVTPLQKAQVVELVKKYKKAVTLAIGDGANDVSMIKTAHIGVGISGQEGIQAVLASDYSFSQFKFLQRLLLVHGRWSYLRMCKFLCYFFYKNFAFTMVHFWFGFFCGFSAQTVYDQYFITLYNIVYTSLPVLAMGVFDQDVPEQRSMEYPKLYEPGQLNLLFNKREFFICIAQGIYTSVLMFFIPYGVFADATRDDGTQLADYQSFAVTVATSLVIVVSVQIGLDTGYWTAINHFFIWGSLAVYFAILFAMHSNGLFDMFPNQFRFVGNAQNTLAQPTVWLTIVLTTVVCIMPVVAFRFLRLNLKPDLSDTVRYTQLVRKKQKAQHRCMRRVGRTGSRRSGYAFSHQEGFGELIMSGKNMRLSSLALSSFTTRSSSSWIESLRRKKSDSASSPSGGADKPLKG

SEQ ID NO: 21 - DNA, 3570 bp, Homo sapiens
  CDS (1)...(3570)
atggcagtgtgtgcaaaaaagcgccccccagaagaagaaaggagggcgcgggctaatgaccgagaatacaatgagaaattccagtatgcgagtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatcctccagcaggagcagtggatgaatgtctgtgttggtgatattatcaagctagaaaataaccagtttgtggcggcggatctcctcctcctttccagcagtgagtcccatgggctgtgttacatagagacagcagaacttgatggcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtgatgtgtttgacgtcctgggacacaaagctgaattgggagagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggagagaggtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcatagtgcggaatccagaggggaagatccgactctactgcaaaggggctgacactatcctactggacagactgcaccactccactcaagagctgctcaacaccaccatggaccaccttaatgagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatgctgctgggtgcaacggccattgaggacaaacttcagcaaggggttccagagaccattgccctcctgacactggccaacatcaagatttgggtgctaaccggagacaagcaagagacggctgtgaacatcggctattcctgcaagatgctgacggatgacatgactgaggttttcatagtcactggccatactgtcctggaggtgcgggaggagctcaggaaagcccgggagaagatgatggactcatcccgctctgtaggcaacggcttcacctatcaggacaagctttcttcttccaagctaacttctgtcctggaggccgttgctggggagtacgccctggtcataaatggtcacagcctggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaacggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccagaccgtctatgaccagtatttcatcaccctgtataacatcgtgtacacctccctgccagtcctggctatgggggtctttgatcaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggtgtttgctgatgccacccgggatgatggcactcagctggctgactaccagtcctttgcagtcactgtggccacatccttggtcattgtggttagcgtgcagattgggctcgacacaggctactggacggccatcaaccacttcttcatctggggaagccttgctgtttactttgccatcctctttgccatgcacagcaatgggctcttcgacatgtttcccaaccagttccggtttgtggggaatgcccagaacaccttggcccagcccacggtgtggctgaccattgtgctcaccacggtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggc

SEQ ID NO: 22 - protein, 1251 aa, Homo sapiens
MSTERDSETTFDEDSQPNDEVVPYSDDETEDELDDQGSAVEPEQNRVNREAEENREPFRKECTWQVKANDRKYHEQPHFMNTKFLCIKESKYANNAIKTYKYNAFTFIPMNLFEQFKRAANLYFLALLILQAVPQISTLAWYTTLVPLLVVLGVTAIKDLVDDVARHKMDKEINNRTCEVIKDGRFKVAKWKEIQVGDVIRLKKNDFVPADILLLSSSEPNSLCYVETAELDGETNLKFKMSLEITDQYLQREDTLATFDGFIECEEPNNRLDKFTGTLFWRNTSFPLDADKILLRGCVIRNTDFCHGLVIFAGADTKIMKNSGKTRFKRTKIDYLMNYMVYTIFVVLILLSAGLAIGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKEIEEKEFTEWNKKFMAASVASTNRDEALDKVYEEIEKDLILLGATAIEDKLQDGVPETISKLAKADIKIWVLTGDKKETAENIGFACELLTEDTTICYGEDINSLLHARMENQRNRGGVYAKFAPPVQESFFPPGGNRALIITGSWLNEILLEKKTKRNKILKLKFPRTEEERRMRTQSKRRLEAKKEQRQKNFVDLACECSAVICCRVTPKQKAMVVDLVKRYKKAITLAIGDGANDVNMIKTAHIGVGISGQEGMQAVMSSDYSFAQFRYLQRLLLVHGRWSYIRMCKFLRYFFYKNFAFTLVHFWYSFFNGYSAQTAYEDWFITLYNVLYTSLPVLLMGLLDQDVSDKLSLRFPGLYIVGQRDLLFNYKRFFVSLLHGVLTSMILFFIPLGAYLQTVGQDGEAPSDYQSFAVTIASALVITVNFQIGLDTSYWTFVNAFSIFGSIALYFGIMFDFHSAGIHVLFPSAFQFTGTASNALRQPYIWLTIILTVAVCLLPVVAIRFLSMTIWPSESDKIQKHRKRLKAEEQWQRRQQVFRRGVSTRRSAYAFSHQRGYADLISSGRSIRKKRSPLDAIVADGTAEYRRTGDS

SEQ ID NO: 23 - protein, 9 aa, Artificial sequence
  consensus sequence for P-type ATPase sequence 1 motif
  VARIANT 1: Xaa= Asp, Asn or Ser
  VARIANT 2: Xaa=  Gln, Glu, Asn or Arg
  VARIANT 3: Xaa= Ser or Ala
  VARIANT 4: Xaa= Leu, IIe, Val, Ser, Ala, or Asn
  VARIANT 5: Xaa= Leu, IIe, or Val
  VARIANT 6: Xaa= Thr, Ser or Asn
  VARIANT 9: Xaa= Ser or Asn
XXXXXXGEX

SEQ ID NO: 24 - protein, 10 aa, Artificial sequence
  consensus sequence for P-type ATPase sequence 2 motif
  VARIANT 1: Xaa= Leu, IIe or Val
  VARIANT 2: Xaa= Cys, Ala, Met, or Leu
  VARIANT 3: Xaa= Ser, Thr, Phe, or Leu
  VARIANT 9: Xaa= Leu or IIe
XXXDKTGTXT

SEQ ID NO: 25 - protein, 11 aa, Artificial sequence
  consensus sequence for P-type ATPase sequence 3 motif
  VARIANT 1: Xaa= Thr, IIe or Val
  VARIANT 5: Xaa= any amino acid
  VARIANT 8: Xaa= Ala, Ser or Gly
  VARIANT 10: Xaa= Ala, Ser or Val
XGDGXNDXPXL

SEQ ID NO: 26 - protein, 7 aa, Artificial sequence
  consensus sequence for E1-E2 ATPases phosphorylation site
  VARIANT 6: Xaa= Leu, IIe, Val, or Met
  VARIANT 7: Xaa= Thr or IIe
DKTGTXX

SEQ ID NO: 27 - DNA, 3524 bp, Homo sapiens
  CDS (600)...(1784)
aattcccgggtcgacccacgcgtccgcccacgcgtccggattaaatgagtgagtatttgtaaaacacttaaaacagtgactgacttgggctaccccttttgggtcccctccctttgtatgggagctctgttttcactctattaaatcttgcaacttcacactcttccagtctgtgtttgttatggctcaagctgagctttcgctcgctgtccaccactgctgtttgctgccatcgcagacccgccgctgacttccacccctctggatccggcagggtgtccactgcacctctggtccagcgaggtggtgcccattgccgctcccaatcgggctaggggcttgccattgttcctgcacgggctaagtgccctgggttcatgctaattgagctgaatagagctgtaacactcactgtatggcccaaggttccattccttggaatctgtgaggccaagaaccccaggtcagagaagaagaggcttgccgccatcttggaagcagcccgccaccatcttgggagctctaagaacaaggaccccccggtaacattttggccaccatgaagggacttccaaagcgcatgggtaggttctctctccatggggatgattttcttttgctgcccaatagtcagtgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacatgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaacaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaaatctacattttgaccatactaccctttcatgttcttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagattgcttgagcccaggagtttgagaccagcctgggcaacatagcaagatcctgtctctactaaaaaaaaaaaaaaaaaaaaaaagccggccg

SEQ ID NO: 28 - protein, 394 aa, Homo sapiens [sequence omitted]

SEQ ID NO: 29 - DNA, 1176 bp, Homo sapiens
  CDS (1)...(1176)
atgattttcttttgctgcccaatagtcagtgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatt

SEQ ID NO: 30 - DNA, 1855 bp, Homo sapiens
  CDS (377)...(1594)
ccgggtcgacccacgcgtccgcggacgcgtgggccccttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccagtgggatcttgtgtgtgataatgcctggaaggtccatatcgctaagttctccttactggttggattaatctttggctacctaataactgggtgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcgctcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaaaaaaaaaaaaaaaaaaaaaaaaaaaagggcggccgc

SEQ ID NO: 31 - protein, 405 aa, Homo sapiens
MFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 32 - DNA, 1215 bp, Homo sapiens
  CDS (1)...(1215)
atgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcgctcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatg

SEQ ID NO: 33 - DNA, 7745 bp, Homo sapiens
  CDS (94)...(3495)
agcttgcggccgcactagtaccccggagcccatgggcgcgccgagccgggcgcgggggcgctgaacggcggagcgggagcggccggaggagccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtagtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacgtgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgaaagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcataagttcctacacacggacgtgtgatacacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacatgtctcccacacgtgagctcccacacatgtacacatgcacatgtacgcaccacaaacacatgcgcaggctcctgcaggcgtgaatacacacatgcacacacatatacacacacgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgc

SEQ ID NO: 34 - protein, 1134 aa, Homo sapiens
MDCSLVRTLVHRYCAGEENWVDSRTIYVGHREPPPGAEAYIPQRYPDNRIVSSKYTFWNFIPKNLFEQFRRVANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRGDGTCHVTTASLDGESSHKTHYAVQDTKGFHTEEDIGGLHATIECEQPQPDLYKFVGRINVYSDLNDPVVRPLGSENLLLRGATLKNTEKIFGVAIYTGMETKMALNYQSKSQKRSAVEKSMNAFLIVYLCILISKALINTVLKYVWQSEPFRDEPWYNQKTESERQRNLFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDRKKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQTKSQCLSVEQSTIFMLSQTSSSLSF

SEQ ID NO: 35 - DNA, 3405 bp, Homo sapiens
  CDS (1)...(3405)
gccatggactgcagcctcgtgcggacgctcgtgcacagatactgtgcaggagaagagaattgggtggacagcaggaccatctacgtgggacacagggagccacctccgggcgcagaggcctacatcccacagagatacccagacaacaggatcgtctcgtccaagtacacattttggaactttatacccaagaatttatttgaacaattcagaagagtagccaacttttatttccttatcatatttctggtgcagttgattattgatacacccacaagtccagtgacaagcggacttccactcttctttgtcattactgtgacggctatcaaacagggttatgaagactggcttcgacataaagcagacaatgccatgaaccagtgtcctgttcatttcattcagcacggcaagctcgttcggaaacaaagtcgaaagctgcgagttggggacattgtcatggttaaggaggacgagacctttccctgcgacttgatcttcctttccagcaaccggggagatgggacgtgccacgtcaccaccgccagcttggatggagaatccagccataaaacgcattacgcggtccaggacaccaaaggcttccacacagaggaggatatcggcggacttcacgccaccatcgagtgtgagcagccccagcccgacctctacaagttcgtgggtcgcatcaacgtttacagtgacctgaatgaccccgtagtgaggcccttaggatcggaaaacctgctgcttagaggagctacactgaagaacactgagaaaatctttggtgtggctatttacacgggaatggaaaccaagatggcattaaattatcaatcaaaatctcagaagcgatctgccgtggaaaaatcgatgaatgcgttcctcattgtgtatctctgcattctgatcagcaaagccctgataaacactgtgctgaaatacgtgtggcagagtgagccctttcgggatgagccgtggtataatcagaaaacggagtcggaaaggcagaggaatctgttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgaaagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcgcttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttc

SEQ ID NO: 36 - DNA, 7205 bp, Homo sapiens
  CDS (157)...(4920)
gcccacgcgtccggtcatgtttctcccctggggtttgcagcctggcttttcatttttagtatccttctgaaagaagagagaaaaattttcagcaaagaaggcaagtaaaagatgaaaattaaattatgagaattaaaaagacaacattgagcagagatgaaaaaggaagggaggaaaaggtggaaaagaaaagaagacaagaagcgagtagtggtctctaacttgctctttgaaggatggtctcacaaagagaaccccaacagacatcatcgtgggaatcaaatcaagaccagcaagtacaccgtgttgtccttcgtccccaaaaacatttttgagcagctacaccggtttgccaatctctattttgtgggcattgcggttctgaattttatccctgtggtcaatgctttccagcctgaggtgagcatgataccaatctgtgttatcctggcagtcactgccatcaaggacgcttgggaagacctccggaggtacaaatcggataaagtcatcaataaccgagagtgcctcatctacagcagaaaagagcagacctatgtgcagaagtgctggaaggatgtgcgtgtgggagacttcatccaaatgaaatgcaatgagattgtcccagcagacatactcctccttttttcctctgaccccaatgggatatgccatctggaaactgccagcttggatggagagacaaacctcaagcaaagacgtgtcgtgaagggcttctcacagcaggaggtacagttcgaaccagagcttttccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctaaagatggatcggatggatggatggatggatcggatggattcatggatggatggatggatggatacgatggatggattgatggatgggtgggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatggtatagaagctcccaagggctccatccctctttctaaaaggaaataccctgctctcctaagaaacgaggagataaaagacattctcctggctctcttagaggctgtgtggcatttccacaagttgcttcctgtatccctgtggtcttccttgtcacagatcagggctgttccaattacttgtaaactttcatttgtttacaaagctaagcgactggagaccccaaaggagctggactcagatggtgaagagtggacccaataccaatgcctgtccttctcggctagatgggcccaggatccagcaactatgagaagccaaaaaggtgctcagcctctgaggaggagccagagtgcccgggtgcccatccagggccactaccggcaaaggtctatggggcaccgtgaaagctcacagcctcctgtggccttcagcagctccatagaaaaagatgtaactccagataaaaacctactgaccaaggttcgagatgctgccctgtggttggagaccttgtcagacagcagacctgccaaggcttccctctccaccacctcctccattgctgatttcttccttgccttaaccatctgcaactctgtcatggtgtccacaaccaccgagcccaggcagaggtgggatgatcaaaagatagtggaaaatgaccattgtcaatgcttagaatttcagggctggaggaaaatatctggcttcacttattgcaaaagtaccttcatattccgcataagacaacttggtattatttccaacattgagagtaatattccactttccttctttggccacaaggtcaccatcaaaccctcaagcaaggctctggggacgtccctggagaagattcagcagctcttccagaagttgaagctattgagcctcagccagtcattctcatccactgcaccctctgacacagacctcggggagagcttaggggccaacgtggccaccacagactcggatgagagagatgatgcatctgtgtgcagtggaggtgactccactgatgacggtggctacaggagcagcatgtgggaccagggcgacatcctggagtctgggtcaggcacttccttggaggaggcattggaggccccagccacagacctggccaggcctgagttctgttacgaggctgagagccctgatgaggccgccctggtgcacgctgcccatgcctacagcttcacactagtgtcccggacacctgagcaggtgactgtgcgcctgccccagggcacctgcctcaccttcagcctcctctgcaccctgggctttgactctgtcaggaagagaatgtctgtggttgtgaggcacccactgactggcgagattgttgtctacaccaagggtgctgactcggtcatcatggacctgctggaagacccagcctgcgtacctgacattaatatggaaaagaagctgagaaaaatccgagcccggacccaaaagcatctagacttgtatgcaagagatggcctgcgcacactatgcattgccaagaaggttgtaagcgaagaggacttccggagatgggccagtttccggcgtgaggctgaggcatccctcgacaaccgagatgagcttctcatggaaactgcacagcatctggagaatcaactcaccttacttggagccactgggatcgaagaccggctgcaggaaggagttccagatacgattgccactctgcgggaggctgggatccagctctgggtcctgactggagataagcaggagacagcggtcaacattgcccattcctgcagactgttaaatcagaccgacactgtttataccatcaatacagagaatcaggagacctgtgaatccatcctcaattgtgcattggaagagctaaagcaatttcgtgaactacagaagccagaccgcaagctctttggattccgcttaccttccaagacaccatccatcacctcagaagctgtggttccagaagctggattggtcatcgatgggaagacattgaatgccatcttccagggaaagctagagaagaagtttctggaattgacccagtattgtcggtccgtcctgtgctgccgctccacgccactccagaagagtatgatagtcaagctggtgcgagacaagttgcgcgtcatgaccctttccataggtgatggagcaaatgatgtaagcatgattcaagctgctgatattggaattggaatatctggacaggaaggcatgcaggctgtcatgtccagcgactttgccatcacccgctttaagcatctcaagaagttgctgctcgtgcatggccactggtgttactcgcgcctggccaggatggtggtgtactacctctacaagaacgtgtgctacgtcaacctgctcttctggtatcagttcttctgtggtttctccagctccaccatgattgattactggcagatgatattcttcaatctcttctttacctccttgcctcctcttgtctttggagtccttgacaaagacatctctgcagaaacactcctggcattgcctgagctatacaagagtggccagaactctgagtgctataacctgtcgactttctggatttctatggtggatgcattctaccagagcctcatctgtttctttatcccttacctggcctataagggctctgatatagatgtctttacctttgggacaccaatcaacaccatctccctcaccacaatccttttgcaccaggcaatggaaatgaagacatggaccattttccacggagtcgtgctcctcggcagcttcctgatgtactttctggtatccctcctgtacaatgccacctgcgtcatctgcaacagccccaccaatccctattgggtgatggaaggccagctctcaaaccccactttctacctcgtctgctttctcacaccagttgttgctcttctcccaagatactttttcctgtctctgcaaggaacttgtgggaagtctctaatctcaaaagctcagaaaattgacaaactccccccagacaaaagaaacctggaaatccagagttggagaagcagacagaggcctgcccctgtccccgaagtggctcgaccaactcaccacccagtgtcatctatcacaggacaggacttcagtgccagcaccccaaagagctctaaccctcccaagaggaagcatgtggaagagtcagtactccacgaacagagatgtggcacggagtgcatgagggatgactcatgctcaggggactcctcagctcaactctcatccggggagcacctgctgggacctaacaggataatggcctactcaagaggacagactgatatgtgccggtgctcaaagaggagcagccatcgccgatcccagagttcactgaccatatgaggagctgcagaaatctgtacaaactcaacagaggccacctagtcactggtccacataacccttgaccccttcttcttcatagaggaaacaatgtgccagtcttattcttttcttcaacaaccttgacttccatggaggaagtgctggccccaaggggtctgacacaaagacgggaaacccagtcggcctctagttttctgctgctctcaggcagcacatcttgcaaacagtttggagaaggaggctgtttttgttgaatcgagttctcaaatcggtttagaccaaagccattcttctgaccctctagataagcgtagcctacaacccagtgccgtaagtttccaagattcaagaagtgtatcaacccaggcaatatctcaggatatggaagtttctgggtttatttacccctcagtgcccagagttaaagtttcagaagagacttgtgcacataagggcttcatctcaagtgtattgcagtaatggctgaatcggggttaacatcccttccaggcacagcgagttggttctgctttttgcctgtaagccaaagaaaagccacatctaaaaagctactactaaaagccagaaagaaaagtggatttgaactcagtgtcacagactcttctgagtgttttagggtcacagctagtgtaagaggcatgaagaatagacatgcaaaagggaacgggtgcaccagagacccctgttttggctgacagaccatatgtcccaccagctggggaatctgacaagaggacataggtggcactctttttttaaagctatttattgtatctatttttaaataaaattgcccatcctcattcagctcttagaacaaaagcaaaaaaccctgtaaatcaggagatataagcacatctgcacccagaataggcccatatgatagggcaaccctgagcttaaacaatgacatcttcaagggtagaactaatctgaaacccccttccagcctctggaagacactggcctgcatcagttagagtcagagcaagtgtcacttcacagggaaaagaaggattatatagacttcctatccctagagtttataaatgtcaactatataaaaaaagctcaaaacagtgttaaaggaatgaacagtagaattttaataggctgtccaaagaagccaggtctgctgtgggcaagtatagcctaaccctagtcttgtaaaataagccagaaagggttactgagccaccttaagctagtacctatatagtaggcaaaaagtacagaaatagatgcaataagtgtggtgagtctttgagcctacgagtcatgccaccagccataagttgacctatcacttgagaacctcctcagcaaagatgccagaaaacattcaatcaagttggcaaatgacacagggagctggccctctgaccatcttcctggcaaacctggactggaagggccatttgcagcactgtcctggagctaatacactgtttcactgcctctgccatataatgatgccagcactagccagctggtgggtatttggaggaatcctgcatgaggattgcccaataaggggcaggtacacatacctggcaaagtgatgatgatgtgaattgtttccagtgaggggattgagtcaaaacttggatctcaggtacctcaatttttcccccaatttctggctactactaaaagccagaaagaacagaacagtggcctcaggagatctgagtttgaatccttgctctctaggatgcaggtggcttgaagcagaatgccacacctgcaagttgattagaactgcctttcttcccaggcttgacataggtattaagtcaaaattacatgaaacccagtggtaaaaaagcctctgaaagctgtaacaccctcagtaataacaaaagggatttttatttcacagctaaagggaaaataggtggagaagttaaaaaataatgtctgatcctgttcctaagttccaaactatagccaacactctgatgctgctctttttcttgtaggaccaaccgtcccagtttgcctgggactttctcatttttacagagtcccaaatcctaggaaactggagcaactggtacaactggtcacctactcttgcccctctgtaaatcaagccaactgtgaccatccaatgtgccatcttacagggaaaagttataaccactattcccctataacataatgctaatgattgtacttagtacatttttatacttttatgatattttactgattggaaatgtcatcctttattaaaaataaacatggttttccat

SEQ ID NO: 37 - protein, 1588 aa, Homo sapiens [sequence omitted]

SEQ ID NO: 38 - DNA, 4764 bp, Homo sapiens
  CDS (1)...(4764)
atgaaaaaggaagggaggaaaaggtggaaaagaaaagaagacaagaagcgagtagtggtctctaacttgctctttgaaggatggtctcacaaagagaaccccaacagacatcatcgtgggaatcaaatcaagaccagcaagtacaccgtgttgtccttcgtccccaaaaacatttttgagcagctacaccggtttgccaatctctattttgtgggcattgcggttctgaattttatccctgtggtcaatgctttccagcctgaggtgagcatgataccaatctgtgttatcctggcagtcactgccatcaaggacgcttgggaagacctccggaggtacaaatcggataaagtcatcaataaccgagagtgcctcatctacagcagaaaagagcagacctatgtgcagaagtgctggaaggatgtgcgtgtgggagacttcatccaaatgaaatgcaatgagattgtcccagcagacatactcctccttttttcctctgaccccaatgggatatgccatctggaaactgccagcttggatggagagacaaacctcaagcaaagacgtgtcgtgaagggcttctcacagcaggaggtacagttcgaaccagagcttttccacaataccatcgtgtgtgagaaacccaacaaccacctcaacaaatttaagggttatatggagcatcctgaccagaccaggactggctttggctgtgagagtcttctgcttcgaggctgcaccatcagaaacaccgagatggctgttggcattgtcatctatgcaggccatgagacgaaagccatgctgaacaacagtggcccccggtacaaacgcagcaagattgagcggcgcatgaatatagacatcttcttctgcattgggatcctcatcctcatgtgccttattggagctaaagatggatcggatggatggatggatggatcggatggattcatggatggatggatggatggatacgatggatggattgatggatgggtgggtcacagcatctggaatgggacctttgaagaacaccctcccttcgatgtgccagatgccaatggcagcttccttcccagtgcccttgggggcttctacatgttcctcacaatgatcatcctgctccaggtgctgatccccatctctttgtatgtctccattgagctggtgaagctcgggcaagtgttcttcttgagcaatgaccttgacctgtatgatgaagagaccgatttatccattcaatgtcgagccctcaacatcgcagaggacttgggccagatccagtacatcttctccgataagacggggaccctgacagagaacaagatggtgttccgacgttgcaccatcatgggcagcgagtattctcaccaagaaaatggtatagaagctcccaagggctccatccctctttctaaaaggaaataccctgctctcctaagaaacgaggagataaaagacattctcctggctctcttagaggctgtgtggcatttccacaagttgcttcctgtatccctgtggtcttccttgtcacagatcagggctgttccaattacttgtaaactttcatttgtttacaaagctaagcgactggagaccccaaaggagctggactcagatggtgaagagtggacccaataccaatgcctgtccttctcggctagatgggcccaggatccagcaactatgagaagccaaaaaggtgctcagcctctgaggaggagccagagtgcccgggtgcccatccagggccactaccggcaaaggtctatggggcaccgtgaaagctcacagcctcctgtggccttcagcagctccatagaaaaagatgtaactccagataaaaacctactgaccaaggttcgagatgctgccctgtggttggagaccttgtcagacagcagacctgccaaggcttccctctccaccacctcctccattgctgatttcttccttgccttaaccatctgcaactctgtcatggtgtccacaaccaccgagcccaggcagaggtgggatgatcaaaagatagtggaaaatgaccattgtcaatgcttagaatttcagggctggaggaaaatatctggcttcacttattgcaaaagtaccttcatattccgcataagacaacttggtattatttccaacattgagagtaatattccactttccttctttggccacaaggtcaccatcaaaccctcaagcaaggctctggggacgtccctggagaagattcagcagctcttccagaagttgaagctattgagcctcagccagtcattctcatccactgcaccctctgacacagacctcggggagagcttaggggccaacgtggccaccacagactcggatgagagagatgatgcatctgtgtgcagtggaggtgactccactgatgacggtggctacaggagcagcatgtgggaccagggcgacatcctggagtctgggtcaggcacttccttggaggaggcattggaggccccagccacagacctggccaggcctgagttctgttacgaggctgagagccctgatgaggccgccctggtgcacgctgcccatgcctacagcttcacactagtgtcccggacacctgagcaggtgactgtgcgcctgccccagggcacctgcctcaccttcagcctcctctgcaccctgggctttgactctgtcaggaagagaatgtctgtggttgtgaggcacccactgactggcgagattgttgtctacaccaagggtgctgactcggtcatcatggacctgctggaagacccagcctgcgtacctgacattaatatggaaaagaagctgagaaaaatccgagcccggacccaaaagcatctagacttgtatgcaagagatggcctgcgcacactatgcattgccaagaaggttgtaagcgaagaggacttccggagatgggccagtttccggcgtgaggctgaggcatccctcgacaaccgagatgagcttctcatggaaactgcacagcatctggagaatcaactcaccttacttggagccactgggatcgaagaccggctgcaggaaggagttccagatacgattgccactctgcgggaggctgggatccagctctgggtcctgactggagataagcaggagacagcggtcaacattgcccattcctgcagactgttaaatcagaccgacactgtttataccatcaatacagagaatcaggagacctgtgaatccatcctcaattgtgcattggaagagctaaagcaatttcgtgaactacagaagccagaccgcaagctctttggattccgcttaccttccaagacaccatccatcacctcagaagctgtggttccagaagctggattggtcatcgatgggaagacattgaatgccatcttccagggaaagctagagaagaagtttctggaattgacccagtattgtcggtccgtcctgtgctgccgctccacgccactccagaagagtatgatagtcaagctggtgcgagacaagttgcgcgtcatgaccctttccataggtgatggagcaaatgatgtaagcatgattcaagctgctgatattggaattggaatatctggacaggaaggcatgcaggctgtcatgtccagcgactttgccatcacccgctttaagcatctcaagaagttgctgctcgtgcatggccactggtgttactcgcgcctggccaggatggtggtgtactacctctacaagaacgtgtgctacgtcaacctgctcttctggtatcagttcttctgtggtttctccagctccaccatgattgattactggcagatgatattcttcaatctcttctttacctccttgcctcctcttgtctttggagtccttgacaaagacatctctgcagaaacactcctggcattgcctgagctatacaagagtggccagaactctgagtgctataacctgtcgactttctggatttctatggtggatgcattctaccagagcctcatctgtttctttatcccttacctggcctataagggctctgatatagatgtctttacctttgggacaccaatcaacaccatctccctcaccacaatccttttgcaccaggcaatggaaatgaagacatggaccattttccacggagtcgtgctcctcggcagcttcctgatgtactttctggtatccctcctgtacaatgccacctgcgtcatctgcaacagccccaccaatccctattgggtgatggaaggccagctctcaaaccccactttctacctcgtctgctttctcacaccagttgttgctcttctcccaagatactttttcctgtctctgcaaggaacttgtgggaagtctctaatctcaaaagctcagaaaattgacaaactccccccagacaaaagaaacctggaaatccagagttggagaagcagacagaggcctgcccctgtccccgaagtggctcgaccaactcaccacccagtgtcatctatcacaggacaggacttcagtgccagcaccccaaagagctctaaccctcccaagaggaagcatgtggaagagtcagtactccacgaacagagatgtggcacggagtgcatgagggatgactcatgctcaggggactcctcagctcaactctcatccggggagcacctgctgggacctaacaggataatggcctactcaagaggacagactgatatgtgccggtgctcaaagaggagcagccatcgccgatcccagagttcactgaccata

SEQ ID NO: 39 - DNA, 978 bp, Homo sapiens
  CDS (357)...(845)
gaaaatcccacctccaggctccattaatccttccaatggagtggaagtttctctcacagagaaactagtaaggggatccaatgggaaaagwacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtgagaggttcccgcggctcagggaagatggcggcagccgtggtgctggctgctgggttgcgcgcggcgcgcagagccgtggcggccacgggggtgcgcggggggcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaaaaaaaaaaaaaaaaaaaaaaaaaaaaaaaaaaaaaa

SEQ ID NO: 40 - protein, 163 aa, Homo sapiens
MAAAVVLAAGLRAARRAVAATGVRGGQVRGAAGVTDGNEVAKAQQATPGGAAPTIFSRILDKSLPADILYEDQQCLVFRDVAPQAPVHFLVIPKKPIPRISQAEEEDQQLLGHLLLVAKQTAKAEGLGDGYRLVINDGKLGAQSVYHLHIHVLGGRQLQWPPG

SEQ ID NO: 41 - DNA, 489 bp, Homo sapiens
  CDS (1)...(489)
atggcggcagccgtggtgctggctgctgggttgcgcgcggcgcgcagagccgtggcggccacgggggtgcgcggggggcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggt

SEQ ID NO: 42 - protein, 9 aa, Artificial sequence
  motif
  VARIANT 1: Xaa= Asp, Asn, or Ser
  VARIANT 2: Xaa= Gln, Glu, Asn, or Arg
  VARIANT 3: Xaa= Ser or Ala
  VARIANT 4: Xaa= Leu, Ile, Val, Ser, Ala, or Asn
  VARIANT 5: Xaa= Leu, Ile, or Val
  VARIANT 6: Xaa= Thr, Ser, or Asn
  VARIANT 9: Xaa= Ser or Asn
XXXXXXGEX

SEQ ID NO: 43 - protein, 10 aa, Artificial sequence
  motif
  VARIANT 1: Xaa= Leu, Ile, or Val
  VARIANT 2: Xaa= Cys, Ala, Met, or Leu
  VARIANT 3: Xaa= Ser, Thr, Phe, or Leu
  VARIANT 9: Xaa= Leu or Ile
XXXDKTGTXT

SEQ ID NO: 44 - protein, 11 aa, Artificial sequence
  motif
  VARIANT 1: Xaa= Thr, Ile, or Val
  VARIANT 5: Xaa= any amino acid
  VARIANT 8: Xaa= Ala, Ser, or Gly
  VARIANT 10: Xaa= Ala, Ser, or Val
XGDGXNDXPXL

SEQ ID NO: 45 - protein, 7 aa, Artificial sequence
  motif
  VARIANT 6: Xaa= Leu, Ile, Val, or Met
  VARIANT 7: Xaa= Thr or Ile
DKTGTXX

SEQ ID NO: 46 - protein, 1187 aa, Mus musculus
MDCSLLRTLVRRYCAGEENWVDSRTIYVGHKEPPPGAEAYIPQRYPDNRIVSSKYTFWNFIPKNLFEQFRRIANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRADGTCHVTTASLDGESSHKTHYAVQDTKGFHTEADVDSLHATIECEQPQPDLYKFVGRINVYNDLNDPVVRPLGSENLLLRGATLKNTEKIFGVAIYTGMETKMALNYQSKSQKRSAVEKSMNTFLIVYLCILVSKALINTVLKYVWQSEPFRDEPWYNEKTESERQRNLFLRAFTDFLAFMVLFNYIIPVSMYVTVEMQKFLGSYFITWDEDMFDEEMGEGPLVNTSDLNEELGQVEYIFTDKTGTLTENNMAFKECCIEGHVYVPHVICNGQVLPDSSGIDMIDSSPGVCGREREELFFRAICLCHTVQVKDDHCGDDVDGPQKSPDAKSCVYISSSPDEVALVEGVQRLGFTYLRLKDNYMEILNRENDIERFELLEVLTFDSVRRRMSVIVKSTTGEIYLFCKGADSSIFPRVIEGKVDQVRSRVERNAVEGLRTLCVAYKRLEPEQYEDACRLLQSAKVALQDREKKLAEAYEQIEKDLVLLGATAVEDRLQEKAADTIEALQKAGIKVWVLTGDKMETASATCYACKLFRRSTQLLELTTKKLEEQSLHDVLFDLSKTVLRCSGSMTRDSFSGLSTDMHDYGLIIDGAALSLIMKPREDGSSSGNYRELFLEICRNCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDIAKNALLRWRVFIYWTFLGVFDALVFFFGAYFIFENTTVTINGQMFGNWTFGTLVFTVMVLTVTLKLALDTHYWTWINHFVIWGSLLFYIAFSLLWGGVIWPFLSYQRMYYVFISMLSSGPAWLGIILLVTVGLLPDVLKKVLCRQLWPTATERTQNIQHQDSISEFTPLASLPSWGAQGSRLLAAQCSSPSGRVVCSRWESEECPVLPLHPGLPHKARYGCCRSSLEMPT

SEQ ID NO: 47 - protein, 1508 aa, Mus musculus
MERELPAAEESASSGWRRPRRRRWEGRTRTVRSNLLPPLGTEDSTIGAPKGERLLMRGCIQHLADNRLKTTKYTLLSFLPKNLFEQFHRLANVYFVFIALLNFVPAVNAFQPGLALAPVLFILAVTAIKDLWEDYSRHRSDHEINHLGCLVFSREEKKYVNRYWKEIRVGDFVRLCCNEIIPADILLLSSSDPDGLCHIETANLDGETNLKRRQVVRGFSELVSEFNPLTFTSVIECEKPNNDLSRFRGYIMHSNGEKAGLHKENLLLRGCTIRNTEAVAGIVIYAGHETKALLNNSGPRYKRSQLERQMNCDVLWCVLLLVCISLFSAVGHGLWVRRYQEKKALFDVPESDGSSLSPATAAVYSFFTMIIVLQVLIPISLYVSIEIVKVCQVYFINQDIELYDEETDSQLQCRALNITEDLGQIKYIFSDKTGTLTENKMVFRRCTVSGIEYSHDANAQRLARYQEADSEEEEVVSKVGTISHRGSTGSHQSIWMTHKTQSIKSHRRTGSRAEAKRASMLSKHTAFSSPMEKDITPDPKLLEKVSECDRFLAIARHQEHPLAHLSPELSDVFDFFIALTICNTVVVTSPDQPRQKVRVRFELKSPVKTIEDFLRRFTPSRLASGCSSIGNLSTSKSSHKSGSAFLPSLSQDSMLLGLEEKLGQTAPSIASNGYASQAGQEESWASDCTTDQKCPGEQREQQEGELRYEAESPDEAALVYAARAYNCALVDRLHDQVSVELPHLGRLTFELLHTLGFDSIRKRMSVVIRHPLTDEINVYTKGADSVVMDLLLPCSSDDARGRHQKKIRSKTQNYLNLYAVEGLRTLCIAKRVLSKEEYACWLQSHIEAEASVESREELLFQSAVRLETNLHLLGATGIEDRLQEGVPETIAKLRQAGLQIWVLTGDKQETAINIAYACKLLDHGEEVITLNADSQEACAALLDQCLSYVQSRNPRSTLQNSESNLSVGFSFNPVSTSTDASPSPSLVIDGRSLAYALEKSLEDKFLFLAKQCRSVLCCRSTPLQKSMVVKLVRSKLKAMTLAIGDGANDVSMIQVADVGVGISGQEGMQAVMASDFAVPRFRYLERLLIVHGHWCYSRLANMVLYFFYKNTMSVGLLFWFQFYCGFSASAMIDQWYLIFFNLLFSSLPQLVTGVLDKDVPADMLLREPQLYKSGQNMEEYRPRAFWLNMVDAAFQSLVCFFIPYLAYYDSDVDVFTWGTPVTAIALFTFLLHLGIETKTWTWLNWLACGFSTFLFFSVALIYNTSCATCYPPSNPYWTMQTLLGDPLFYLTCLIAPIAALLPRLFFKALQGSLFPTQLQLGRQLAKKPLNKFSDPKETFAQGQPPGHSETELSERKTMGPFETLPRDCASQASQFTQQLTCSPEASGEPSAVDTNMPLRENTLLEGLGSQASGSSMPRGAISEVCPGDSKRQSSSASQTARLSSLFHLPSFGSLNWISSLSLASGLGSVLQLSGSSLQMDKQDGEFLSNPPQPEQDLHSFQGQVTGYL

SEQ ID NO: 48 - protein, 126 aa, Homo sapiens
MADEIAKAQVARPGGDTIFGKIIRKEIPAKIIFEDDRCLAFHDISPQAPTHFLVIPKKHISQISVAEDDDESLLGHLMIVGKKCAADLGLNKGYRMVVNEGSDGGQSVYHVHLHVLGGRQMHWPPG

SEQ ID NO: 49 - protein, 147 aa, Homo sapiens
MSFRFGQHLIKPSVVFLKTELSFALVNRKPVVPGHVLVCPLRPVERFHDLRPDEVADLFQTTQRVGTVVEKHFHGTSLTFSMQDGPEAGQTVKHVHVHVLPRKAGDFHRNDSIYEELQKHDKEDFPASWRSEEEMAAEAAALRVYFQ

SEQ ID NO: 50 - protein, 19 aa, Artificial sequence
  HIT family signature motif consensus sequence
  VARIANT 1: Xaa = Asn, Gly, or Ala
  VARIANT 2, 3, 4, 5, 7, 9, 11: Xaa = any amino acid
  VARIANT 6: Xaa = Gly, Ser, Ala,, or Val
  VARIANT 8: Xaa = Gln or Phe
  VARIANT 10: Xaa = Leu, Ile, Val, or Met
  VARIANT 13: Xaa = Leu, Ile, Val, Met, Phe, Tyr, Ser, or Thr
  VARIANT 15: Xaa = Leu, Ile, Val, Met, Phe, or Thr
  VARIANT 17, 18: Xaa = Leu, Ile, Val, Met, or Phe
  VARIANT 19: Xaa = Pro, Ser, Gly, or Ala
XXXXXXXXXXXHXHXHXXX

SEQ ID NO: 51 - DNA, 2725 bp, Homo sapiens
  CDS (180)...(2033)
ccacgcgtccggccttccgaaatagaaacaaagttggtcacaaatcacattagctttgcccgaagtttttccccacactcttctttagcatgctattatggggaaagtgaccactcctgggagcgggggtggtcggggcggtttggtggcggggaagcggctgtaacttctacgtgaccatggtacctgttgaaaacaccgagggccccagtctgctgaaccagaaggggacagccgtggagacggagggcagcggcagccggcatcctccctgggcgagaggctgcggcatgtttaccttcctgtcatctgtcactgctgctgtcagtggcctcctggtgggttatgaacttgggatcatctctggggctcttcttcagatcaaaaccttattagccctgagctgccatgagcaggaaatggttgtgagctccctcgtcattggagccctccttgcctcactcaccggaggggtcctgatagacagatatggaagaaggacagcaatcatcttgtcatcctgcctgcttggactcggaagcttagtcttgatcctcagtttatcctacacggttcttatagtgggacgcattgccataggggtctccatctccctctcttccattgccacttgtgtttacatcgcagagattgctcctcaacacagaagaggccttcttgtgtcactgaatgagctgatgattgtcatcggcattctttctgcctatatttcaaattacgcatttgccaatgttttccatggctggaagtacatgtttggtcttgtgattcccttgggagttttgcaagcaattgcaatgtattttcttcctccaagccctcggtttctggtgatgaaaggacaagagggagctgctagcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtattttttgtacaaatcactggccaaccaaacatattgttctatgcatcaactgttttgaagtcagttggatttcaaagcaatgaggcagctagcctcgcctccactggggttggagtcgtcaaggtcattagcaccatccctgccactcttcttgtagaccatgtcggcagcaaaacattcctctgcattggctcctctgtgatggcagcttcgttggtgaccatgggcatcgtaaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaatgccctggctggtgctcagcgagatctttcctggtgggatcagaggacgagccatggctttaacttctagcatgaactggggcatcaatctcctcatctcgctgacatttttgactgtaactgatcttattggcctgccatgggtgtgctttatatatacaatcatgagtctagcatccctgctttttgttgttatgtttatacctgagacaaagggatgctctttggaacaaatatcaatggagctagcaaaagtgaactatgtgaaaaacaacatttgttttatgagtcatcaccaagaagaattagtgccaaaacagcctcaaaaaagaaaaccccaggagcagctcttggagtgtaacaagctgtgtggtaggggccaatccaggcagctttctccagagacctaatggcctcaacaccttctgaacgtggatagtgccagaacacttaggagggtgtctttggaccaatgcatagttgcgactcctgtgctctcttttcagtgtcatggaactggttttgaagagacactctgaaatgataaagacagcctttaatccccctcctccccagaaggaacctcaaaaggtagatgaggtacaaggtcctaagtgatctctttttctgagcaggatatcaggttaaaaaaaaaaagttactggctggtttaatactttctaccttcttcacagagcagcctttgaatagactatgtcctagtgaagacatcaacctccgccttaagctatgtatgtatggaggccagtcgcagctttattatgcagacacacaagtggtctggacatgagggtacagtttctgcctaccaagacactacttgcactggatcttacgcaaaaaagaaccagaacacacagtgtggacaactgcccatatattctatctagattaggagagggtcctggctaggattttagtggtaattcctagttacattcaacaagtataaagattatagagcttattttatgaactataaactataatttaatgcaaaatatccttttatgaatttcatgttaatattgtgaaatattaaaataattccgcaataaaaaaaaaaaaaaagggcggccgc

SEQ ID NO: 52 - protein, 617 aa, Homo sapiens
MVPVENTEGPSLLNQKGTAVETEGSGSRHPPWARGCGMFTFLSSVTAAVSGLLVGYELGIISGALLQIKTLLALSCHEQEMVVSSLVIGALLASLTGGVLIDRYGRRTAIILSSCLLGLGSLVLILSLSYTVLIVGRIAIGVSISLSSIATCVYIAEIAPQHRRGLLVSLNELMIVIGILSAYISNYAFANVFHGWKYMFGLVIPLGVLQAIAMYFLPPSPRFLVMKGQEGAASKVLGRLRALSDTTEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGSSVMAASLVTMGIVNLNIHMNFTHICRSHNSINQSLDESVIYGPGNLSTNNNTLRDHFKGISSHSRSSLMPLRNDVDKRGETTSASLLNAGLSHTEYQIVTDPGDVPAFLKWLSLASLLVYVAAFSIGLGPMPWLVLSEIFPGGIRGRAMALTSSMNWGINLLISLTFLTVTDLIGLPWVCFIYTIMSLASLLFVVMFIPETKGCSLEQISMELAKVNYVKNNICFMSHHQEELVPKQPQKRKPQEQLLECNKLCGRGQSRQLSPET

SEQ ID NO: 53 - DNA, 1854 bp, Homo sapiens
  CDS (1)...(1854)
atggtacctgttgaaaacaccgagggccccagtctgctgaaccagaaggggacagccgtggagacggagggcagcggcagccggcatcctccctgggcgagaggctgcggcatgtttaccttcctgtcatctgtcactgctgctgtcagtggcctcctggtgggttatgaacttgggatcatctctggggctcttcttcagatcaaaaccttattagccctgagctgccatgagcaggaaatggttgtgagctccctcgtcattggagccctccttgcctcactcaccggaggggtcctgatagacagatatggaagaaggacagcaatcatcttgtcatcctgcctgcttggactcggaagcttagtcttgatcctcagtttatcctacacggttcttatagtgggacgcattgccataggggtctccatctccctctcttccattgccacttgtgtttacatcgcagagattgctcctcaacacagaagaggccttcttgtgtcactgaatgagctgatgattgtcatcggcattctttctgcctatatttcaaattacgcatttgccaatgttttccatggctggaagtacatgtttggtcttgtgattcccttgggagttttgcaagcaattgcaatgtattttcttcctccaagccctcggtttctggtgatgaaaggacaagagggagctgctagcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtattttttgtacaaatcactggccaaccaaacatattgttctatgcatcaactgttttgaagtcagttggatttcaaagcaatgaggcagctagcctcgcctccactggggttggagtcgtcaaggtcattagcaccatccctgccactcttcttgtagaccatgtcggcagcaaaacattcctctgcattggctcctctgtgatggcagcttcgttggtgaccatgggcatcgtaaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaatgccctggctggtgctcagcgagatctttcctggtgggatcagaggacgagccatggctttaacttctagcatgaactggggcatcaatctcctcatctcgctgacatttttgactgtaactgatcttattggcctgccatgggtgtgctttatatatacaatcatgagtctagcatccctgctttttgttgttatgtttatacctgagacaaagggatgctctttggaacaaatatcaatggagctagcaaaagtgaactatgtgaaaaacaacatttgttttatgagtcatcaccaagaagaattagtgccaaaacagcctcaaaaaagaaaaccccaggagcagctcttggagtgtaacaagctgtgtggtaggggccaatccaggcagctttctccagagacctaa

SEQ ID NO: 54 - DNA, 2230 bp, Homo sapiens
  CDS (376)...(1962)
gtcgacccacgcgtccggcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaaaaaaaaaaaaaaagggcggccgc

SEQ ID NO: 55 - protein, 528 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 56 - DNA, 1587 bp, Homo sapiens
  CDS (1)...(1587)
atggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctga

SEQ ID NO: 57 - DNA, 4632 bp, Homo sapiens
  CDS (225)...(3581)
  misc_feature 4611: n = a,c,t, or g
cacgcgtccgcccacgcgtccgcccacgcgtccgagccccctttcaagccttagcttccggctccaagccgaccccctccccctccctgtccccttccccttctcccatccctctctcggccacagcgtcttgttagtcctctccctctactccgcaatattttctttctttctccctcctctcctccatttgttgtttgatgtttcccactctttgaggaaggatggttgatttggagagcgaagtgccccctctgcctcccaggtacaggtttcgagatttgctgctaggggaccaaggatggcaaaacgatgacagagtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctgcatttgtgggatccaacatctggaacgaataggaaagaggctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcaagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacggacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacctgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataaccccctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcgaaaaatagcatcacaatctcaaatatctatcagtgtagaagagtgggaagacaccaaagactccaaagaacaagggcaccaccgcagcaaccaccgcaactcaacatccagtgaccagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttgataaaaataaaatgagaaacttttttcctacaaagaccttgcttgaaaccacaaaagttttgctggcacgaaagaaactagatggaaatatatgtaattctctcatatttaaaaacgtaatctcttctcttagaagtatagatcattttgaaacttaatgtactacttactggtactctccctattaatatttgaaggacctcaatggaataaatttgaaaagctaaattaaaatacaaaaatttaaatctgacatttaattgttttataataatccaaactctatgaaagcaattttaaaaattattaaggttttatgaagttgacaaaatctaactatatttggtgcatcacaatggacacagaatgctgctgctcctcttaaaaattaaatgtgtcatattatattctttaaacttactgttttacaaaattgagctcatcgtaaatgtctagtcttctcacatagagattaaccaacaaacttgtgtggctgacttttgtgtaagaatcatagtttgctttagaatacaaatctttaagtcattttaacttttttttctgccttacgatataaaaatatttatcttagaatttgagatgttcatagcatgttttattacattgaagaaactaaaacataaatgaaaagaaacactaggttcctgcactttttggtaactttatgtctagcaaatattttatgccaagaaaagcatactataaagcaaatatctattattctcctaaacgaatgcctagcatagagaaaatacttaatacacatttgttgacttaaatttaattcaaggattgaaaaattaactggatatcttgaaatatacagtaatgattgtccttagactcttgaactttaccatctttcctattcatatatctatatagtaaatttcactagaaaaattcttttaaaattgacagaagataatttataccttttatggactctgaagacacttcaaaacattaaaagtccttatgtctttggtaatgaaacatacactcaatgangatgtattaaattttgactt

SEQ ID NO: 58 - protein, 1118 aa, Homo sapiens
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKRLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESRKIASQSQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 59 - DNA, 3357 bp, Homo sapiens
  CDS (1)...(3357)
atggttgatttggagagcgaagtgccccctctgcctcccaggtacaggtttcgagatttgctgctaggggaccaaggatggcaaaacgatgacagagtacaagttgaattctatatgaatgaaaatacatttaaagaaagactaaaattatttttcataaaaaaccagagatcaagtctaaggatacgcctgttcaatttttctctcaaattactaagctgcttattatacataatccgagtactactagaaaacccttcacaaggaaatgaatggtctcatatcttttgggtgaacagaagtctacctttgtggggcttacaggtttcagtggcattgataagtctgtttgaaacaatattacttggttatcttagttataagggaaacatctgggaacagattttacgaatacccttcatcttggaaataattaatgcagttcccttcattatctcaatattctggccttccttaaggaatctatttgtcccagtctttctgaactgttggcttgccaaacatgccttggaaaatatgattaatgatctacacagagccattcagcgtacacagtctgcaatgtttaatcaagttttgattttaatatctacattactatgccttatcttcacctgcatttgtgggatccaacatctggaacgaataggaaagaggctgaatctctttgactccctttatttctgcattgtgacgttttctactgtgggcttcggggatgtcactcctgaaacatggtcctccaagctttttgtagttgctatgatttgtgttgctcttgtggttctacccatacagtttgaacagctggcttatttgtggatggagagacaaaagtcaggaggaaactatagtcgacatagagctcaaactgaaaagcatgtcgtcctgtgtgtcagctcactgaagattgatttacttatggattttttaaatgaattctatgctcatcctaggctccaggattattatgtggtgattttgtgtcctactgaaatggatgtacaggttcgaagggtactgcagattccaatgtggtcccaacgagttatctaccttcaaggttcagcccttaaagatcaagacctattgagagcaaagatggatgacgctgaggcctgttttattctcagtagccgttgtgaagtggataggacatcatctgatcaccaaacaattttgagagcatgggctgtgaaagattttgctccaaattgtcctttgtatgtccagatattaaagcctgaaaataaatttcacatcaaatttgctgatcatgttgtttgtgaagaagagtttaaatacgccatgttagctttaaactgtatatgcccagcaacatctacacttattacactactggttcatacctctagagggcaagaaggccagcaatcgccagaacaatggcagaagatgtacggtagatgctccgggaatgaagtctaccacattgttttggaagaaagtacattttttgctgaatatgaaggaaagagttttacatatgcctctttccatgcacacaaaaagtttggcgtctgcttgattggtgttaggagggaggataataaaaacattttgctgaatccaggtcctcgatacattatgaattctacggacatatgcttttatattaatattaccaaagaagagaattcagcatttaaaaaccaagaccagcagagaaaaagcaatgtgtccaggtcgttttatcatggaccttccagattacctgtacatagcataattgccagcatgggtactgtggctatagacctgcaagatacaagctgtagatcagcaagtggccctaccctgtctcttcctacagagggaagcaaagaaataagaagacctagcattgctcctgttttagaggttgcagatacatcatcgattcaaacatgtgatcttctaagtgaccaatcagaagatgaaactacaccagatgaagaaatgtcttcaaacttagagtatgctaaaggttacccaccttattctccatatataggaagttcacccactttttgtcatctccttcatgaaaaagtaccattttgctgcttaagattagacaagagttgccaacataactactatgaggatgcaaaagcctatggattcaaaaataaactaattatagttgcagctgaaacagctggaaatggattatataactttattgttcctctcagggcatattatagaccaaagaaagaacttaatcccatagtactgctattggataaccccctagatgacttactcaggtgtggagtgacttttgctgctaatatggtggttgtggataaagagagcaccatgagtgccgaggaagactacatggcagatgccaaaaccattgtgaacgtgcagacactcttcaggttgttttccagtctcagtattatcacagagctaactcaccccgccaacatgagattcatgcaattcagagccaaagactgttactctcttgctctttcaaaactggaaaagaaagaacgggagagaggctctaacttggcctttatgtttcgactgccttttgctgctgggagggtgtttagcatcagtatgttggacactctgctgtatcagtcatttgtgaaggattatatgatttctatcacgagacttctgttgggactggacactacaccaggatctgggtttctttgttctatgaaaatcactgcagatgacttatggatcagaacttatgccagactttatcagaagttgtgttcttctactggagatgttcccattggaatctacaggactgagtctcagaaacttactacatctgagtctcgaaaaatagcatcacaatctcaaatatctatcagtgtagaagagtgggaagacaccaaagactccaaagaacaagggcaccaccgcagcaaccaccgcaactcaacatccagtgaccagtcggaccatcccttgctgcggagaaaaagcatgcagtgggcccgaagactgagcagaaaaggcccaaaacactctggtaaaacagctgaaaaaataacccagcagcgactgaacctctacaggaggtcagaaagacaagagcttgctgaacttgtgaaaaatagaatgaaacacttgggtctttctacagtgggatatgatgaaatgaatgatcatcaaagtaccctctcctacatcctgattaacccatctccagataccagaatagagctgaatgatgttgtatacttaattcgaccagatccactggcctaccttccaaacagtgagcccagtcgaagaaacagcatctgcaatgtcactggtcaagattctcgggaggaaactcaactttga

SEQ ID NO: 60 - DNA, 2847 bp, Homo sapiens
  CDS (561)...(2477)
ccacgcgtccggccctgtgcttcggatggcggcgggaggttgatggcgagtggtgctgaagggacagctccagcagtggctgatttgggggagaaacaaaatctgcagatggaatccgagcagggcgacttcaccttcaagtggtgagctctcctgacctgcggccagtctccactccattcacggccagccgatctgcccgctcccggaggggtcgggcagtgccggctggacccgccccgagctccatggtttgcccaaccctgcgcgatggtgactctgggcgcggaggttggcgactggcaaatccgcagatcacagaatgaaggcggggagcgcggccggcggccggcgggggctttctcccccaccccagcgcccagggaagcggctcaaccacctgaatccggaaaacgccaacaagtagtttctcgtcggagaagggcggctcacctgggcgccaagactcagtcccgctgcccagagaacctcgtccactcggaaaccaaagcagaaccacttttctctcggtctcgttaagtcatgtctgagtcacagagatgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaaggatatgaaaaatcccgaagcttaaacaacatagcgggcttggcaggcaatgctctgaggctctctccagtaacatcaccctacaactctccttgtcctctgaggcgctctcgatctcccatcccatctatcttgtaaaccaaacaaccaaactgcatcagtcggctaaattgtattaattcaagygctgtttaccccataatggaaataattaaatgtagagttactccaggctccattaatacagtataaatcttgcgtgatactacaatttgaagtcagaaatgccacttgggtagctaatgaatcttacccaggctttaaagattgtctaaagtagtgctaagatccctcctattaattgccctgatatccttttgcaataaaatgacagatagtgtcagatattgaccagtgcactaatatataaacataccctcagggagatatatttaaaacagtgtgcttccaaatgccaaccacttcattggaactttatttcttgtga

SEQ ID NO: 61 - protein, 638 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKGYEKSRSLNNIAGLAGNALRLSPVTSPYNSPCPLRRSRSPIPSIL

SEQ ID NO: 62 - DNA, 1917 bp, Homo sapiens
  CDS (1)...(1917)
atgggcaagatcgagaacaacgagagggtgatcctcaatgtcgggggcacccggcacgaaacctaccgcagcaccctcaagaccctgcctggaacacgcctggcccttcttgcctcctccgagcccccaggcgactgcttgaccacggcgggcgacaagctgcagccgtcgccgcctccactgtcgccgccgccgagagcgcccccgctgtcccccgggccaggcggctgcttcgagggcggcgcgggcaactgcagttcccgcggcggcagggccagcgaccatcccggtggcggccgcgagttcttcttcgaccggcacccgggcgtcttcgcctatgtgctcaattactaccgcaccggcaagctgcactgccccgcagacgtgtgcgggccgctcttcgaggaggagctggccttctggggcatcgacgagaccgacgtggagccctgctgctggatgacctaccggcagcaccgcgacgccgaggaggcgctggacatcttcgagacccccgacctcattggcggcgaccccggcgacgacgaggacctggcggccaagaggctgggcatcgaggacgcggcggggctcgggggccccgacggcaaatctggccgctggaggaggctgcagccccgcatgtgggccctcttcgaagacccctactcgtccagagccgccaggtttattgcttttgcttctttattcttcatcctggtttcaattacaactttttgcctggaaacacatgaagctttcaatattgttaaaaacaagacagaaccagtcatcaatggcacaagtgttgttctacagtatgaaattgaaacggatcctgccttgacgtatgtagaaggagtgtgtgtggtgtggtttacttttgaatttttagtccgtattgttttttcacccaataaacttgaattcatcaaaaatctcttgaatatcattgactttgtggccatcctacctttctacttagaggtgggactcagtgggctgtcatccaaagctgctaaagatgtgcttggcttcctcagggtggtaaggtttgtgaggatcctgagaattttcaagctcacccgccattttgtaggtctgagggtgcttggacatactcttcgagctagtactaatgaatttttgctgctgataattttcctggctctaggagttttgatatttgctaccatgatctactatgccgagagagtgggagctcaacctaacgacccttcagctagtgagcacacacagttcaaaaacattcccattgggttctggtgggctgtagtgaccatgactaccctgggttatggggatatgtacccccaaacatggtcaggcatgctggtgggagccctgtgtgctctggctggagtgctgacaatagccatgccagtgcctgtcattgtcaataattttggaatgtactactccttggcaatggcaaagcagaaacttccaaggaaaagaaagaagcacatccctcctgctcctcaggcaagctcacctactttttgcaagacagaattaaatatggcctgcaatagtacacagagtgacacatgtctgggcaaagacaatcgacttctggaacataacagatcagtgttatcaggtgacgacagtacaggaagtgagccgccactatcacccccagaaaggctccccatcagacgctctagtaccagagacaaaaacagaagaggggaaacatgtttcctactgacgacaggtgattacacgtgtgcttctgatggagggatcaggaaaggatatgaaaaatcccgaagcttaaacaacatagcgggcttggcaggcaatgctctgaggctctctccagtaacatcaccctacaactctccttgtcctctgaggcgctctcgatctcccatcccatctatcttgtaa

SEQ ID NO: 63 - DNA, 6582 bp, Homo sapiens
  CDS (524)...(3913)
ccacgcgtccgcccacgcgtccgcccacgcgtccgagaaggcttaggtgggcaggcaggacgagagaaagactgagaggagggaaagccgcgtaggtgggagtacagcggcgcgagggtcgagggggaaccctcgtcggtgcagatgaggagggtgggctttcagaactagtcccccctcgcaccccgccccgcccctcccgcgctggggtcttcacggtgccctgcctcagagcccggctccaccacgcccggaagagggagtctggccgtcggctggctcagggcgggccggttggctgtacccaggctccctggcccgagtgcgggaccagagcgcggggcggcgcggcagccgcgggccgaggaggggctgcgagcgaaacggcgcggcgcggcacggcggacgagttagggccggggcgagggaggctgtggctcccgacagagacaggggagtagtgtcgggctgaggcgagacagcccggtagagcccagctcagcgcccggcagccttcgacgcgatgttccgccggagcttgaatcgtttttgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattggctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggagaaatctgagctgtagaagggcatctgactcattatccgccagaccttcagtcagacctcttcttttacgaacattctcagacgaatctaatgtattgtaacagaatccgaatcttgaactgcctatgttattgtcctacaagcatactgacagtggttacagctaaaaaagaaagcatgaagaaacaactacaaaaagttatcatctcaggatacttgatatgcaacacactaaaccactctcatgtctagagttcacaataaatgttcattaaaataccaaatgattctcttaagcatttaccattattgtaagtagcctttatggccaaagctgtaagttaagaattatatgaaagttgaaagcaagaatacttagaattctggctttagttagagtaatataactcaaatgggtgctcttttaacccatgaactttgtgaatggatttaaatacaatagtatgaagtagaagttatgcaatgagaatgaatagattttgctaatactactttttttgcctggcagaagaaatagactatttggatcacatttctcattcctcctaaatgatcatcttaattttttttcccaagtacataaggaatacttgaaaatacagaataactaaatagtatcaatgcatcagacagaatagttaatcccttctgtttacccatgtgctactaatgtcttggtagaatattcttgccaaaaaaataccttgaacgcttatgtggaaagtgttaacttacgggtatttttgtgggaatagaaaaaaattgtttattttttattcttctgaattaaaccccacttatgggtgtaagcctactagacttgaaaataaagtataaaacatttccaatcacttagtagcccctcaaagtagttagaaaataaacagatttttccagtgttgattttactgggatctgcagtaaggtggtttaaaccatagttatataaaaataaaggtcattctgaatatcagccttttataattttatgtgaagaggaagaaatatagcttattttaaacttttgacggtttttatttgaaagagattgcatttatgcatatatgcagtgctttttcttaaacttggccaatttggaaagggggaaggagccaccccaaaacggtggttcagcttgtagagccatgactctgtgaagatgaatgttgtctcttaacttggacagggaaatggtctaactctaaaccatgtaactgaccttagtaaagtccttgactaactgaactagaaggaaggtttagccttctaattagttcacttgaaacataaatgtgaaatgtcttcattcaatgttaaacacatacttttttggatataaatgaccatatttatttgactgctagtttttttgttttttttttgtctttctggcatgcctgtactattattaatgtttatattgtaccttgatttggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccgtgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgataaaaaaaaaaaaaaaaaaaaaaaaaaaaaaaaaaaaaaaaaaaaaaaaaaaaaaaaaaa

SEQ ID NO: 64 - protein, 1129 aa, Homo sapiens
MFRRSLNRFCAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDWLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGIKGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARRNLSCRRASDSLSARPSVRPLLLRTFSDESNVL

SEQ ID NO: 65 - DNA, 3390 bp, Homo sapiens
  CDS (1)...(3390)
atgttccgccggagcttgaatcgtttttgtgctggagaagagaaacgagttggcacacgcacagtgtttgttggcaatcatccagtttcggaaacagaagcttacattgcacaaagattttgtgataatagaatagtctcatctaagtatacactttggaattttctcccaaagaatctgtttgaacagtttagaagaattgcaaatttttattttctcataatcttccttgtacaggtcacagtagacacaccaactagcccagttaccagtggacttccacttttctttgttataactgttacagccatcaagcagggatatgaggattggctgagacacagagctgacaatgaagtcaacaaaagcactgtttacattattgaaaatgcaaagcgagtgagaaaagaaagtgaaaaaatcaaggttggtgatgtagtagaagtacaggcagatgaaacctttccctgtgatcttattcttctatcatcttgcaccactgatggaacctgttatgtcactacagccagtcttgatggggaatccaattgcaagacacattatgcagtacgtgataccattgcactgtgtacagcagaatccatcgataccctccgagcagcaattgaatgtgaacagcctcaacctgacctctacaaatttgttgggcgaatcaatatctacagtaatagtcttgaggctgttgccaggtctttgggacctgaaaatctcttgctgaaaggagctacgctaaaaaataccgagaagatatatggagttgctgtttacactggaatggaaaccaaaatggctttgaactaccaagggaaatctcagaaacgttctgctgttgaaaaatctattaatgctttcctgattgtatatttatttatcttactgaccaaagctgcagtatgcactactctaaagtatgtttggcaaagtaccccatacaatgatgaaccttggtataaccaaaagactcagaaagagcgagagaccttgaaggttttaaaaatgttcaccgacttcctatcatttatggttctattcaactttatcattcctgtctccatgtacgtcacagtagaaatgcagaaattcttgggctccttcttcatctcatgggataaggacttttatgatgaagaaattaatgaaggagccctggttaacacatcagaccttaatgaagaacttggtcaggtggattatgtatttacagataagactggaacactcactgaaaacagcatggaattcattgaatgctgcatagatggccacaaatataaaggtgtaactcaagaggttgatggattatctcaaactgatggaactttaacatattttgacaaagtagataagaatcgagaagagctgtttctacgtgccttgtgtttatgtcatactgtagaaatcaaaacaaacgatgctgttgatggagctacagaatcagctgaattaacctatatctcctcttcaccagatgaaatagctttggtgaaaggagctaaaaggtacgggttcacatttttaggaaatcgaaatggatatatgagagtagagaaccaaagaaaagaaatagaagaatatgaacttcttcacaccttaaactttgatgctgtccggcgacgtatgagtgtaattgtgaagactcaagaaggagacatacttctcttttgtaaaggagcagactcggcagtttttcccagagtgcaaaatcatgaaattgagttaactaaagtccatgtggaacgtaatgcaatggatgggtatcggacactctgtgtagccttcaaagaaattgctccagatgattatgaaagaattaacagacagctcatagaggcaaaaatggccttacaagacagagaagaaaaaatggaaaaagttttcgatgatattgagacaaacatgaatttaattggagccactgcagttgaagacaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccattacagaaagcccagattgtcagaatggtgaagaatttaaaaggcagcccaataactctgtcgataggtgatggtgccaatgatgttagtatgatcttggaatcccatgtgggaataggtattaaaggcaaagaaggtcgccaagcagctaggaatagcgattattctgttccaaagtttaaacacttaaagaaactgctgttggctcatggacatctatattatgtgagaatagcacaccttgtacagtacttcttctataagaacctttgtttcattttgccacagtttttgtaccagttcttctgtggattctcacaacagccactgtatgatgctgcttaccttacaatgtacaatatctgcttcacatccttgcccatcctggcctatagtctactggaacagcacatcaacattgacactctgacctcagatccccgattgtatatgaaaatttctggcaatgccatgctacagttgggccccttcttatattggacatttctggctgcctttgaagggacagtgttcttctttgggacttactttctttttcagactgcatccctagaagaaaatggaaaggtatacggaaactggacttttggaaccattgtttttacagtcttagtattcactgtaaccctgaagcttgccttggatacccgattctggacgtggataaatcactttgtgatttggggttctttagccttctatgtatttttctcattcttctggggaggaattatttggccttttctcaagcaacagagaatgtattttgtatttgcccaaatgctgtcttctgtatccacatggttggctataattcttctaatatttatcagcctgttccctgagattcttctgatagtattaaagaatgtaagaagaagaagtgccaggagaaatctgagctgtagaagggcatctgactcattatccgccagaccttcagtcagacctcttcttttacgaacattctcagacgaatctaatgtattgtaa

SEQ ID NO: 66 - DNA, 6073 bp, Homo sapiens
  CDS (273)...(4553)
ccacgcgtccgggaggagcggagggagaagtaggttgcgagctcagcacaggctccggcgctggctcccgcagctgagtttgggagatgtctaagtgatttttttttttcccggaaggcaaatggctggcgtggaagcacaacccgctttcactcttcgaatttgtgcttagctcttttcttgtaccttgcgactcgtgaccaacatgctgtgatgtgtgccgagggaggaattggtcagctacacaacctggatcttaccacagtttggatatgactgaggctctccaatgggccagatatcactggcgacggctgatcagaggtgcaaccagggatgatgattcagggccatacaactattcctcgttgctcgcctgtgggcgcaagtcctctcagatccctaaactgtcaggaaggcaccggattgttgttccccacatccagcccttcaaggatgagtatgagaagttctccggagcctatgtgaacaatcgaatacgaacaacaaagtacacacttctgaattttgtgccaagaaatttatttgaacaatttcacagagctgccagtttatatttcctgttcctagttgtcctgaactgggtacctttggtagaagccttccaaaaggaaatcaccatgttgcctctggtggtggtccttacaattatcgcaattaaagatggcctggaagattatcggaaatacaaaattgacaaacagatcaataatttaataactaaagtttatagtaggaaagagaaaaaatacattgaccgatgctggaaagacgttactgttggggactttattcgcctctcctgcaatgaggtcatccctgcagacatggtactactcttttccactgatccagatggaatctgtcacattgagacttctggtcttgatggagagagcaatttaaaacagaggcaggtggttcggggatatgcagaacaggactctgaagttgatcctgagaagttttccagtaggatagaatgtgaaagcccaaacaatgacctcagcagattccgaggcttcctagaacattccaacaaagaacgcgtgggtctcagtaaagaaaatttgttgcttagaggatgcaccattagaaacacagaggctgttgtgggcattgtggtttatgcaggccatgaaaccaaagcaatgctgaacaacagtgggccacggtataagcgcagcaaattagaaagaagagcaaacacagatgtcctctggtgtgtcatgcttctggtcataatgtgcttaactggcgcagtaggtcatggaatctggctgagcaggtatgaaaagatgcattttttcaatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccaggcttttagacaaatttagtcagattacacctcggctctttatgccactagatgagaccatccaaaatccaccaatggaaactttgtacattatcgactttttcattgcattggcaatttgcaacacagtagtggtttctgctcctaaccaaccccgacaaaagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgcacagaaacagagaaacaacacggtgatgcaggcctcctgaatggcaaggcagagtccctccctggacagccattggcctgcaacctgtgttatgaggccgagagcccagacgaagcggccttagtgtatgccgccagggcttaccaatgcactttacggtctcggacaccagagcaggtcatggtggactttgctgctttgggaccattaacatttcaactcctacacatcctgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaacttcctgtgctattgagcaaggaaacttatctctgtgtgaaactgctttagatcaaggctactctgaaactaaggcctttgagatggctggaccctccaaaggtaaagaaagctagataccctccttggagttgcaagtattctttcaaggttggaagagggattttgaagaggtatctctccaagcaagaatgacttgtttttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccaatcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataaaaaaaaaaaaaaaagggcggccgc

SEQ ID NO: 67 - protein, 1426 aa, Homo sapiens
MTEALQWARYHWRRLIRGATRDDDSGPYNYSSLLACGRKSSQIPKLSGRHRIVVPHIQPFKDEYEKFSGAYVNNRIRTTKYTLLNFVPRNLFEQFHRAASLYFLFLVVLNWVPLVEAFQKEITMLPLVVVLTIIAIKDGLEDYRKYKIDKQINNLITKVYSRKEKKYIDRCWKDVTVGDFIRLSCNEVIPADMVLLFSTDPDGICHIETSGLDGESNLKQRQVVRGYAEQDSEVDPEKFSSRIECESPNNDLSRFRGFLEHSNKERVGLSKENLLLRGCTIRNTEAVVGIVVYAGHETKAMLNNSGPRYKRSKLERRANTDVLWCVMLLVIMCLTGAVGHGIWLSRYEKMHFFNVPEPDGHIISPLLAGFYMFWTMIILLQVLIPISLYVSIEIVKLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIETDVVPDTRLLDKFSQITPRLFMPLDETIQNPPMETLYIIDFFIALAICNTVVVSAPNQPRQKIRHPSLGGLPIKSLEEIKSLFQRWSVRRSSSPSLNSGKEPSSGVPNAFVSRLPLFSRMKPASPVEEEVSQVCESPQCSSSSACCTETEKQHGDAGLLNGKAESLPGQPLACNLCYEAESPDEAALVYAARAYQCTLRSRTPEQVMVDFAALGPLTFQLLHILPFDSVRKRMSVVVRHPLSNQVVVYTKGADSVIMELLSVASPDGASLEKQQMIVREKTQKHLDDYAKQGLRTLCIAKKVMSDTEYAEWLRNHFLAETSIDNREELLLESAMRLENKLTLLGATGIEDRLQEGVPESIEALHKAGIKIWMLTGDKQETAVNIAYACKLLEPDDKLFILNTQSKDACGMLMSTILKELQKKTQALPEQVSLSEDLLQPPVPRDSGLRAGLIITGKTLEFALQESLQKQFLELTSWCQAVVCCRATPLQKSEVVKLVRSHLQVMTLAIGDGANDVSMIQVADIGIGVSGQEGMQAVMASDFAVSQFKHLSKLLLVHGHWCYTRLSNMILYFFYKNVAYVNLLFWYQFFCGFSGTSMTDYWVLIFFNLLFTSAPPVIYGVLEKDVSAETLMQLPELYRSGQKSEAYLPHTFWITLLDAFYQSLVCFFVPYFTYQGSDTDIFAFGNPLNTAALFIVLLHLVIESKSLTWIHLLVIIGSILSYFLFAIVFGAMCVTCNPPSNPYWIMQEHMLDPVFYLVCILTTSIALLPRFVYRVLQGSLFPSPILRAKHFDRLTPEERTKALKKWRGAGKMNQVTSKYANQSAGKSGRRPMPGPSAVFAMKSATSCAIEQGNLSLCETALDQGYSETKAFEMAGPSKGKES

SEQ ID NO: 68 - DNA, 4281 bp, Homo sapiens
  CDS (1)...(4281)
atgactgaggctctccaatgggccagatatcactggcgacggctgatcagaggtgcaaccagggatgatgattcagggccatacaactattcctcgttgctcgcctgtgggcgcaagtcctctcagatccctaaactgtcaggaaggcaccggattgttgttccccacatccagcccttcaaggatgagtatgagaagttctccggagcctatgtgaacaatcgaatacgaacaacaaagtacacacttctgaattttgtgccaagaaatttatttgaacaatttcacagagctgccagtttatatttcctgttcctagttgtcctgaactgggtacctttggtagaagccttccaaaaggaaatcaccatgttgcctctggtggtggtccttacaattatcgcaattaaagatggcctggaagattatcggaaatacaaaattgacaaacagatcaataatttaataactaaagtttatagtaggaaagagaaaaaatacattgaccgatgctggaaagacgttactgttggggactttattcgcctctcctgcaatgaggtcatccctgcagacatggtactactcttttccactgatccagatggaatctgtcacattgagacttctggtcttgatggagagagcaatttaaaacagaggcaggtggttcggggatatgcagaacaggactctgaagttgatcctgagaagttttccagtaggatagaatgtgaaagcccaaacaatgacctcagcagattccgaggcttcctagaacattccaacaaagaacgcgtgggtctcagtaaagaaaatttgttgcttagaggatgcaccattagaaacacagaggctgttgtgggcattgtggtttatgcaggccatgaaaccaaagcaatgctgaacaacagtgggccacggtataagcgcagcaaattagaaagaagagcaaacacagatgtcctctggtgtgtcatgcttctggtcataatgtgcttaactggcgcagtaggtcatggaatctggctgagcaggtatgaaaagatgcattttttcaatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccaggcttttagacaaatttagtcagattacacctcggctctttatgccactagatgagaccatccaaaatccaccaatggaaactttgtacattatcgactttttcattgcattggcaatttgcaacacagtagtggtttctgctcctaaccaaccccgacaaaagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgcacagaaacagagaaacaacacggtgatgcaggcctcctgaatggcaaggcagagtccctccctggacagccattggcctgcaacctgtgttatgaggccgagagcccagacgaagcggccttagtgtatgccgccagggcttaccaatgcactttacggtctcggacaccagagcaggtcatggtggactttgctgctttgggaccattaacatttcaactcctacacatcctgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgacttggattcacttgctggtcatcattggtagcatcttgtcttattttttatttgccatagtttttggagccatgtgtgtaacttgcaacccaccatccaacccttactggattatgcaggagcacatgctggatccagtattctacttagtttgtatcctcacgacgtccattgctcttctgcccaggtttgtatacagagttcttcagggatccctgtttccatctccaattctgagagctaagcactttgacagactaactccagaggagaggactaaagctctcaagaagtggagaggggctggaaagatgaatcaagtgacatcaaagtatgctaaccaatcagctggcaagtcaggaagaagacccatgcctggcccttctgctgtatttgcaatgaagtcagcaacttcctgtgctattgagcaaggaaacttatctctgtgtgaaactgctttagatcaaggctactctgaaactaaggcctttgagatggctggaccctccaaaggtaaagaaagctag

SEQ ID NO: 69 - DNA, 7221 bp, Homo sapiens
  CDS (167)...(3700)
gccgcgggatgggaacgcggcgcggggagtgaggcagtggcggcggcggcggtaagcggaacttcggcccgaggggctcgcccgctcccgcctctgtcttgtcggcctccacctgcagccccgcggcccccgcgccccgcgggacccggacggcgacgacgggggaatgtggcgctggatccggcagcagctgggttttgacccaccacatcagagtgacacaagaaccatctacgtagcccacaggtttcctcagaatggcctttacacacctcagaaatttatagataacaggatcatttcatctaagtacactgtgtggaattttgttccaaaaaatttatttgaacagttcagaagagtggcaaacttttattttcttattatatttttggttcagcttatgattgatacacctaccagtccagttaccagtggacttccattattctttgtgataacagtaactgccataaagcagggatatgaagattggttacggcataactcagataatgaagtaaatggagctcctgtttatgttgttcgaagtggtggccttgtaaaaactagatcaaaaaacattcgggtgggtgatattgttcgaatagccaaagatgaaatttttcctgcagacttggtgcttctgtcctcagatcgactggatggttcctgtcacgttacaactgctagtttggacggagaaactaacctgaagacacatgtggcagttccagaaacagcattattacaaacagttgccaatttggacactctagtagctgtaatagaatgccagcaaccagaagcagacttatacagattcatgggacgaatgatcataacccaacaaatggaagaaattgtaagacctctggggccggagagtctcctgcttcgtggagccagattaaaaaacacaaaagaaatttttggtgttgcggtatacactggaatggaaactaagatggcattaaattacaagagcaaatcacagaaacgatctgcagtagaaaagtcaatgaatacatttttgataatttatctagtaattcttatatctgaagctgtcatcagcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagttcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatat

SEQ ID NO: 70 - protein, 1177 aa, Homo sapiens
MWRWIRQQLGFDPPHQSDTRTIYVAHRFPQNGLYTPQKFIDNRIISSKYTVWNFVPKNLFEQFRRVANFYFLIIFLVQLMIDTPTSPVTSGLPLFFVITVTAIKQGYEDWLRHNSDNEVNGAPVYVVRSGGLVKTRSKNIRVGDIVRIAKDEIFPADLVLLSSDRLDGSCHVTTASLDGETNLKTHVAVPETALLQTVANLDTLVAVIECQQPEADLYRFMGRMIITQQMEEIVRPLGPESLLLRGARLKNTKEIFGVAVYTGMETKMALNYKSKSQKRSAVEKSMNTFLIIYLVILISEAVISTILKYTWQAEEKWDEPWYNQKTEHQRNSSKILRFISDFLAFLVLYNFIIPISLYVTVEMQKFLGSFFIGWDLDLYHEESDQKAQVNTSDLNEELGQVEYVFTDKTGTLTENEMQFRECSINGMKYQEINGRLVPEGPTPDSSEGNLSYLSSLSHLNNLSHLTTSSSFRTSPENETELIKEHDLFFKAVSLCHTVQISNVQTDCTGDGPWQSNLAPSQLEYYASSPDEKALVEAAARIGIVFIGNSEETMEVKTLGKLERYKLLHILEFDSDRRRMSVIVQAPSGEKLLFAKGAESSILPKCIGGEIEKTRIHVDEFALKGLRTLCIAYRKFTSKEYEEIDKRIFEARTALQQREEKLAAVFQFIEKDLILLGATAVEDRLQDKVRETIEALRMAGIKVWVLTGDKHETAVSVSLSCGHFHRTMNILELINQKSDSECAEQLRQLARRITEDHVIQHGLVVDGTSLSLALREHEKLFMEVCRNCSAVLCCRMAPLQKAKVIRLIKISPEKPITLAVGDGANDVSMIQEAHVGIGIMGKEGRQAARNSDYAIARFKFLSKLLFVHGHFYYIRIATLVQYFFYKNVCFITPQFLYQFYCLFSQQTLYDSVYLTLYNICFTSLPILIYSLLEQHVDPHVLQNKPTLYRDISKNRLLSIKTFLYWTILGFSHAFIFFFGSYLLIGKDTSLLGNGQMFGNWTFGTLVFTVMVITVTVKMALETHFWTWINHLVTWGSIIFYFVFSLFYGGILWPFLGSQNMYFVFIQLLSSGSAWFAIILMVVTCLFLDIIKKVFDRHLHPTSTEKAQLTETNAGIKCLDSMCCFPEGEAACASVGRMLERVIGRCSPTHISSSWSASDPFYTNDRSILTLSTMDSSTC

SEQ ID NO: 71 - DNA, 3534 bp, Homo sapiens
  CDS (1)...(3534)
atgtggcgctggatccggcagcagctgggttttgacccaccacatcagagtgacacaagaaccatctacgtagcccacaggtttcctcagaatggcctttacacacctcagaaatttatagataacaggatcatttcatctaagtacactgtgtggaattttgttccaaaaaatttatttgaacagttcagaagagtggcaaacttttattttcttattatatttttggttcagcttatgattgatacacctaccagtccagttaccagtggacttccattattctttgtgataacagtaactgccataaagcagggatatgaagattggttacggcataactcagataatgaagtaaatggagctcctgtttatgttgttcgaagtggtggccttgtaaaaactagatcaaaaaacattcgggtgggtgatattgttcgaatagccaaagatgaaatttttcctgcagacttggtgcttctgtcctcagatcgactggatggttcctgtcacgttacaactgctagtttggacggagaaactaacctgaagacacatgtggcagttccagaaacagcattattacaaacagttgccaatttggacactctagtagctgtaatagaatgccagcaaccagaagcagacttatacagattcatgggacgaatgatcataacccaacaaatggaagaaattgtaagacctctggggccggagagtctcctgcttcgtggagccagattaaaaaacacaaaagaaatttttggtgttgcggtatacactggaatggaaactaagatggcattaaattacaagagcaaatcacagaaacgatctgcagtagaaaagtcaatgaatacatttttgataatttatctagtaattcttatatctgaagctgtcatcagcactatcttgaagtatacatggcaagctgaagaaaaatgggatgaaccttggtataaccaaaaaacagaacatcaaagaaatagcagtaagattctgagatttatttcagacttccttgcttttttggttctctacaatttcatcattccaatttcattatatgtgacagtcgaaatgcagaaatttcttggatcattttttattggctgggatcttgatctgtatcatgaagaatcagatcagaaagctcaagtcaatacttccgatctgaatgaagagcttggacaggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactaattaaagaacatgatctcttctttaaagcagtcagtctctgtcacactgtacagattagcaatgttcaaactgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagttcatggagtgcatcggatcctttctataccaacgacaggagcatcttgactctctccacaatggactcatctacttgttaa

SEQ ID NO: 72 - DNA, 4198 bp, Homo sapiens
  CDS (156)...(3410)
ggagtcgacccacgcgtccgcattgagacaatgcctccacaaatacttgatgcaaaattcagtaagacagcacttgttgaatcaccattatagtttctgacaaattgttctcaaaaaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtgatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggtactgtaataggtgttgtcatttataccggaaaagagactcgaagtgtaatgaacacatccaatccaaaaaataaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaaccctcacccagaatgaaatgatatttaagcggctgcacctgggcaccgtgtcctatggcgccgacacgatggatgagatccagagccatgtcagggactcctactcacagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagtgcggaaacatggctcgcgaaggactgcggaccctcgtggttgcaaagaaggcgttgacagaggagcagtaccaggactttgagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagtcttctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggagaaaaaaaaaaaaaaaaaaaaaaaaaaaa

SEQ ID NO: 73 - protein, 1084 aa, Homo sapiens
MPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMDIHSFEGTFTREDSDPPIHESLSIENTLWASTIVASGTVIGVVIYTGKETRSVMNTSNPKNKVGLLDLELNRLTKALFLALVALSIVMVTLQGFVGPWYRNLFRFLLLFSYIIPISLRVNLDMGKAVYGWMMMKDENIPGTVVRTSTIPEELGRLVYLLTDKTGTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEECGNMAREGLRTLVVAKKALTEEQYQDFESRYTQAKLSMHDRSLKVAAVVESLEREMELLCLTGVEDQLQADVRPTLEMLRNAGIKIWMLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFDVAFITTVTFLWKVSAITVVSCLPLYVLKYLRRKSSPPSYCKLAS

SEQ ID NO: 74 - DNA, 3255 bp, Homo sapiens
  CDS (1)...(3255)
atgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtgatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggtactgtaataggtgttgtcatttataccggaaaagagactcgaagtgtaatgaacacatccaatccaaaaaataaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaaccctcacccagaatgaaatgatatttaagcggctgcacctgggcaccgtgtcctatggcgccgacacgatggatgagatccagagccatgtcagggactcctactcacagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagtgcggaaacatggctcgcgaaggactgcggaccctcgtggttgcaaagaaggcgttgacagaggagcagtaccaggactttgagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttgatgttgcctttatcaccaccgtgaccttcctgtggaaagtgtcggcgatcaccgtggtcagctgcctcccgctgtatgtcctcaagtacctgaggcgcaagtcttctcctcccagctactgcaagctggcctcctaa

SEQ ID NO: 75 - DNA, 4231 bp, Homo sapiens
  CDS (156)...(3443)
ggagtcgacccacgcgtccgcattgagacaatgcctccacaaatacttgatgcaaaattcagtaagacagcacttgttgaatcaccattatagtttctgacaaattgttctcaaaaaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagagctgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtgatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatggacattcacagtttcgaaggcacatttaccagggaagacagtgacccgcccattcatgaaagtctcagcatagaaaatacattgtgggcaagcaccattgttgcatcaggtactgtaataggtgttgtcatttataccggaaaagagactcgaagtgtaatgaacacatccaatccaaaaaataaggttggtttgttggaccttgaactcaatcggctgacgaaagcgctatttttggctttagttgctctttccattgttatggtaaccttacaaggatttgtgggtccatggtaccgcaatctttttcggttccttctcctcttttcttacatcattcccataagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggaaccctcacccagaatgaaatgatatttaagcggctgcacctgggcaccgtgtcctatggcgccgacacgatggatgagatccagagccatgtcagggactcctactcacagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcgctctggtgcagtggacagagagtgtgggcctcacgctggtcagcagggacctcacctccatgcagctgaagacccccagtggccaggtcctcagcttctgcattctgcagctgtttcccttcacctccgagagcaagcggatgggcgtcatcgtcagggatgaatccacggcagaaatcacattctacatgaagggcgctgacgtggccatgtctcctatcgtgcagtataatgactggctggaagaggagtgcggaaacatggctcgcgaaggactgcggaccctcgtggttgcaaagaaggcgttgacagaggagcagtaccaggactttgagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaaggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggctgtgttttcctcagtcttctacttcgcatccgtccctttgtatcagggcttcctcatggtggggtatgccaccatatacaccatgttcccagtgttctccttagtgctggaccaggacgtgaagccagagatggcgatgctctacccggagctgtacaaggacctcaccaagggaagatccttgtccttcaaaaccttcctcatctgggttttaataagtatttaccaaggcggcatcctcatgtatggggccctggtgctcttcgagtctgagttcgtccacgtggtggccatctccttcaccgcactgatcctgaccgagctgctgatggtggcgctgaccgtccgcacgtggcactggctgatggtggtggccgagttcctcagcttaggctgctacgtgtcctcactcgcttttctcaatgaatattttggtataggcagagtgtcttttggagctttcttagatgttgcctttatcaccaccgtgaccttcctgtggaaagtgtcggcgatcaccgtggtcagctgcctcccgctgtatgtcctcaagtacctgaggcgcaagtcttctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcgatggcctcttcctcttaagtgtggggcctcacccctgcttttctttctttttttgtattgtcaaaattgtatttccatattgaagcagcttgagtttctactgaaaatgagcccgaattatttcactattactgtaaagggttcatcttactctggcattctgagaattagactgaaagtttaatttctgcagttccctcatattcagattctttctttgatgttataacacaaagtcattcctactcaaatgtaataaaattgaggctccacggagaaaaaaaaaaaaaaaaaaaaaaaaaaaa

SEQ ID NO: 76 - protein, 1095 aa, Homo sapiens
MPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMDIHSFEGTFTREDSDPPIHESLSIENTLWASTIVASGTVIGVVIYTGKETRSVMNTSNPKNKVGLLDLELNRLTKALFLALVALSIVMVTLQGFVGPWYRNLFRFLLLFSYIIPISLRVNLDMGKAVYGWMMMKDENIPGTVVRTSTIPEELGRLVYLLTDKTGTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEECGNMAREGLRTLVVAKKALTEEQYQDFESRYTQAKLSMHDRSLKVAAVVESLEREMELLCLTGVEDQLQADVRPTLEMLRNAGIKIWMLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFGIGRVSFGAFLDVAFITTVTFLWKVSAITVVSCLPLYVLKYLRRKSSPPSYCKLAS

SEQ ID NO: 77 - DNA, 3255 bp, Homo sapiens; identical to SEQ ID NO: 74
  CDS (1)...(3255)

SEQ ID NO: 78 - protein, 464 aa, Escherichia coli
MPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 79 - protein, 472 aa, Escherichia coli
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 80 - protein, 526 aa, Homo sapiens
MTSDHEHMTAVCASHVQTHGSQLQIQKLSPCFRPPTPAFRISSSIILLGAGLAGPSTGDRWFGVSVVGTGLFLPPLQLLLPPRLLFTHAILERLHLWLALPPVLVLGHALLHCKVGGSTARAGDQLVQRVLLLIVFLHRWVQVWPZGTEVDILGMGSRTGGRRGPELRPGFRISILSAYISNYAFANVFHGWKYMFGLVIPLGVLQAIAMYFLPPSPRFLVMKGQEGAASKVLGRLRALSDTTEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGLLNAGLSHTEYQIVTDPGDVPAFLKWLSLASLLVYVAAFSIGLGPMPWLVLSEIFPGGIRGRAMALTSSMNWGINLLISLTFLTVNLIGLPWVCFIYTIMSLASLLFVVMFIPETKGCSLEQISMELAKVNYVKNNICFMSHHQEELVPKQPQKRKPQEQLLECNKLCGRGQSRQLSPET

SEQ ID NO: 81 - protein, 531 aa, Homo sapiens
MVRNKVAPVEDGANIQRNFEPPPPYTTPTDSPEDKIRSNSTATTASQPEFQGCWTIVVVAILFIINLLNYMDRYTIAGVLNDVQTYYNISDAWAGLIQTTFMVFFIIFSPICGFLGDRYNRKWIFVVGIAIWVSAVFASTFIPSNQFWLFLLFRGIVGIGEASYAIISPTVIADMFTGVLRSRMLMVFYFAIPFGCGLGFVVGSAVASWTGHWQWGVRVTGVLGIVCLLLIIVFVREPERGKAEREKGEIAASTEATSYLDDMKDLLSNATYVTSSLGYTATVFMVGTLAWWAPITIQYADSARRNGTITEDQKANINLVFGALTCVGGVLGVAIGTLVSNMWSRGVGPFKHIQTVRADALVCAIGAAICIPTLILAIQNIESNMNFAWGMLFICIVASSFNWATNVDLLLSVVVPQRRSSASSWQILISHMFGDASGPYILGLISDAIRGNEDTAQAHYKSLVTSFWLCVGTLVLSVILFGISAITVVKDKARFNEIMLAQANKDNTSSGTLPIEDRNTEDETGSEVQHM

SEQ ID NO: 82 - protein, 1237 aa, Rattus norvegicus
MARAKLPRSPSEGKAGPGDTPAGSAAPEEPHGLSPLLPTRGGGSVGSDVGQRLHVEDFSLDSSLSQVQVEFYVNENTFKERLKLFFIKNQRSSLRIRLFNFSLKLLTCLLYIVRVLLDNPDQGIGCWGCTKYNYTFNGSSSEFHWAPILWVERKMALWVIQVIVATISFLETMLLIYLSYKGNIWEQIFHVSFVLEMINTLPFIITVFWPPLRNLFIPVFLNCWLAKHALENMINDFHRAILRTQSAMFNQVLILFCTLLCLVFTGTCGIQHLERAGGNLNLLTSFYFCIVTFSTVGFGDVTPKIWPSQLLVVILICVTLVVLPLQFEELVYLWMERQKSGGNYSRHRARTEKHVVLCVSSLKIDLLMDFLNEFYAHPRLQDYYVVILCPSEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREENKSILLNPGPRHILAASDTCFYINITKEENSAFIFKQEEKQNRRGLAGQALYEGPSRLPVHSIIASMVAMDLQNTDCRPSQGGSGGGGGKLTLPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRRELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKQERENGSNLAFMFRLPFAAGRVFSISMLDTLLYQSFVKDYMITITRLLLGLDTTPGSGYLCAMKVTEDDLWIRTYGRLFQKLCSSSAEIPIGIYRTECHVFSSEPHDLRAQSQISVNMEDCEDTREAKGPWGTRAASGGGSTHGRHGGSADPVEHPLLRRKSLQWARKLSRKSSKQAGKAPMTTDWITQQRLSLYRRSERQELSELVKNRMKHLGLPTTGYEDVANLTASDVMNRVNLGYLQDEMNDHHQNTLSYVLINPPPDTRLEPNDIVYLIRSDPLAHVTSSSQSRKSSCSNKLSSCNPETRDETQL

SEQ ID NO: 83 - protein, 638 aa, Rattus norvegicus
MGKIENNERVILNVGGTRHETYRSTLKTLPGTRLALLASSEPQGDCLTAAGDKLQPLPPPLSPPPRPPPLSPVPSGCFEGGAGNCSSHGGNGSDHPGGGREFFFDRHPGVFAYVLNYYRTGKLHCPADVCGPLFEEELAFWGIDETDVEPCCWMTYRQHRDAEEALDIFETPDLIGGDPGDDEDLGGKRLGIEDAAGLGGPDGKSGRWRKLQPRMWALFEDPYSSRAARFIAFASLFFILVSITTFCLETHEAFNIVKNKTEPVINGTSAVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPLASSPTFCKTELNMACNSTQSDTCLGKENRLLEHNRSVLSGDDSTGSEPPLSPPERLPIRRSSTRDKNRRGETCFLLTTGDYTCASDGGIRKGYEKSRSLNNIAGLAGNALRLSPVTSPYNSPCPLRRSRSPIPSIL

SEQ ID NO: 84 - protein, 1187 aa, Mus musculus; identical to SEQ ID NO: 46

SEQ ID NO: 85 - protein, 1508 aa, Mus musculus; identical to SEQ ID NO: 47

SEQ ID NO: 86 - protein, 1095 aa, Mus musculus
  VARIANT 801, 1005: Xaa = any amino acid
MPLMMSEEGFENDESDYHTLPRARITRRKRGLEWFVCGGWKFLCTSCCDWLINVCQRKKELKARTVWLGCPEKCEEKHPRNSIKNQKYNVFTFIPGVLYEQFKFFLNLYFLVVSCSQFVPALKIGYLYTYWAPLGFVLAVTIAREAIDEFRRFQRDKEMNSQLYSKLTVRGKVQVKSSDIQVGDLIIVEKNQRIPSDMVFLRTSEKAGSCFIRTDQLDGETDWKLKVAVSCTQRLPALGDLFSISAYVYAQKPQLDIHSFEGTFTREDSDPPIHESLSIENTLWASTIVASGTVIGVVIYTGKETRSVMNTSNPNNKVGLLDLELNQLTKALFLALVVLSVVMVTLQGFAGPWYRNLFRFLLLFSYIIPISLRVNLDMGKAAYGWMIMKDENIPGTVVRTSTIPEELGRLVYLLTDKTGTLTQNEMVFKRLHLGTVSYGTDTMDEIQSHVLNSYLQVHSQPSGHNPSSAPLRRSQSSTPKVKKSVSSRIHEAVKAIALCHNVTPVYEARAGITGETEFAEADQDFSDENRTYQASSPDEVALVRWTESVGLTLVSRDLASMQLKTPSGQVLTYCILQMFPFTSESKRMGIIVRDESTAEITFYMKGADVAMSTIVQYNDWLEEECGNMAREGLRTLVVAKRTLTEEQYQDFESRYSQAKLSIHDRALKVAAVVESLEREMELLCLTGVEDQLQADVRPTLEMLRNAGIKIWMLTGDKLETATCIAKSSHLVSRTQDIHVFRPVTSRGEAHLELNAFRRKHDCALVISGDSLEVCLRYYEHELVELACQCPAVVCCRCSPTXKAHIVTLLRQHTRKRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAILYPELYKDLTKGRSLSFKTFLIWVLISIYQGGILMYGALLLFEDEFVHVVAISFTALILTELLXVALTIRTWHWLMVVAEFLSLGCYVASLAFLNEYFGIGRVSFGAFLDVAFITTVTFLWKVSAITVVSCLPLYVLKYLKRKLSPPSYSKLSS

SEQ ID NO: 87 - protein, 9 aa, Artificial sequence
  consensus sequence
  VARIANT 1: Xaa = Asp, Asn, or Ser
  VARIANT 2: Xaa = Gln, Glu, Asn, or Arg
  VARIANT 3: Xaa = Ser or Ala
  VARIANT 4: Xaa = Leu, Ile, Val. Ser, Ala, or Asn
  VARIANT 5: Xaa = Leu, Ile, or Val
  VARIANT 6: Xaa = Thr, Ser, or Asn
  VARIANT 9: Xaa = Ser or Asn
XXXXXXGEX

SEQ ID NO: 88 - protein, 10 aa, Artificial sequence
  consensus sequence
  VARIANT 1: Xaa = Leu, Ile, or Val
  VARIANT 2: Xaa = Cys, Ala, Met, or Leu
  VARIANT 3: Xaa = Ser, Thr, Phe, or Leu
  VARIANT 9: Xaa = Leu or Ile
XXXDKTGTXT

SEQ ID NO: 89 - protein, 11 aa, Artificial sequence
  consensus sequence
  VARIANT 1: Xaa = Thr, Ile, or Val
  VARIANT 5: Xaa = any amino acid
  VARIANT 8: Xaa = Ala, Ser, or Gly
  VARIANT 10: Xaa = Ala, Ser, or Val
XGDGXNDXPXL

SEQ ID NO: 90 - protein, 7 aa, Artificial sequence
  consensus sequence
  VARIANT 6: Xaa = Leu, Ile, Val, or Met
  VARIANT 7: Xaa = Thr or Ile
DKTGTXX

SEQ ID NO: 91 - DNA, 2397 bp, Homo sapiens
  CDS (69)..(1526)
cccgcgagagatggaagcggcggcgaccgccggcggctgccggggcggagaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctgaaaattgaaaaaattaaaatgtaaaaaaattaaagaataaaaatacttctattattcttttatctcagtaagaaataccttaaccaagatatctctcttttatgctactcttttgccactcacttgagaacagaataggatttcaacaataagagaataaaataagaacatgtataacaaaaagctctctccagatcatccctgtgaatgccaaagtaaactttatgtacagtgtaaaaaaaaaaaatctcagttatgtttttattagccaaattctaatgattggctcctggaagtatagaaaactcccattaacataatataagcatcagaaaattgcaaacactagaattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttctgactccaggccaggatgttttatttctcacatcatgtccaagaaaaagaataaattatgttcagcttaaaaaaaaaaaaaaaaaaaaa

SEQ ID NO: 92 - protein, 485 aa, Homo sapiens
MDVMRPLINEQNFDGTSDEEHEQELLPVQKHYQLDDQEGISFVQTLMHLLKGNIGTGLLGLPLAIKNAGIVLGPISLVFIGIISVHCMHILVRCSHFLCLRFKKSTLGYSDTVSFAMEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVVRNMPDPHNLPIVAGWKKYPLFFGTAVFAFEGIGVVLPLENQMKESKRFPQALNIGMGIVTTLYVTLATLGYMCFHDEIKGSITLNLPQDVWLYQSVKILYSFGIFVTYSIQFYVPAEIIIPGITSKFHTKWKQICEFGIRSFLVSITCAGAILIPRLDIVISFVGAVSSSTLALILPPLVEILTFSKEHYNIWMVLKNISIAFTGVVGFLLGTYITVEEIIYPTPKVVAGTPQSPFLNLNSTCLTSGLK

SEQ ID NO: 93 - DNA, 1455 bp, Homo sapiens
  CDS (1)..(1455)
atggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaa

SEQ ID NO: 94 - DNA, 2565 bp, Homo sapiens
  CDS (137)...(1453)
gcgtccggagaaccagacggaggcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagaacctattcctggccttgggtgtcctggcccaaaagcccggcccggtgtccaggcacagcagagtcccctggagacggctcttccggaagcctgctgtctgggcagcccgtcgtcacccgtccggtccagcctgagtatcctcttccagatggccaggtgccggccctggccccctctaaggccaaactcccccctgcagggctggatcttcaacgtggttccttggttggtggcgattccggccagtctattcagtgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccaggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcaagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccacccctagccagcagctcccagtcagacaacagccagaaatgtctccagactctgcccagcctccccaggtagccaccctcgagacacgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaaccttatttaaataataactattaaactattcaaaaagaaaaaaaaaaaaaaaaa

SEQ ID NO: 95 - protein, 438 aa, Homo sapiens
MQPPPDEARRDMAGDTQWSRPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRYLLSEKEPIPGLGCPGPKARPGVQAQQSPLETALPEACCLGSPSSPVRSSLSILFQMARCRPWPPLRPNSPLQGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGVVGVCLGGYLMETTGSWTCLFNLVAIISNLGLCTFLVFGQAQRVDLSSTHEDL

SEQ ID NO: 96 - DNA, 1314 bp, Homo sapiens
  CDS (1)...(1314)
atgcagccacccccagacgaggcccgcagggacatggccggggacacccagtggtccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagaacctattcctggccttgggtgtcctggcccaaaagcccggcccggtgtccaggcacagcagagtcccctggagacggctcttccggaagcctgctgtctgggcagcccgtcgtcacccgtccggtccagcctgagtatcctcttccagatggccaggtgccggccctggccccctctaaggccaaactcccccctgcagggctggatcttcaacgtggttccttggttggtggcgattccggccagtctattcagtgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctc

SEQ ID NO: 97 - DNA, 2558 bp, Homo sapiens
  CDS (137)...(1447)
gcgtccggagaaccagacggaggcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagaacctattcctggccttgggtgtcctggcccaaaagcccggcccggtgtccaggcacagcagagtcccctggagacggctcttccggaagcctgctgtctgggcagcccgtcgtctcccagcctctgcagcctgctccttctcatcctcctctcctgctgcccaccttcttcgaggagaccttccccgacgcagggctggatcttcaacgtggttccttggttggtggcgattccggccagtctattcagtgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccaggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccacccctagccagcagctcccagtcagacaacagccagaaatgtctccagactctgcccagcctccccaggtagccaccctcgagacacgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaaccttatttaaataataactattaaactattcaaaaagaaaaaaaaaaaaaaaaa

SEQ ID NO: 98 - protein, 436 aa, Homo sapiens
MQPPPDEARRDMAGDTQWSRPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRYLLSEKEPIPGLGCPGPKARPGVQAQQSPLETALPEACCLGSPSSPSLCSLLLLILLSCCPPSSRRPSPTQGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGVVGVCLGGYLMETTGSWTCLFNLVAIISNLGLCTFLVFGQAQRVDLSSTHEDL

SEQ ID NO: 99 - DNA, 1308 bp, Homo sapiens
  CDS (1)...(1308)
atgcagccacccccagacgaggcccgcagggacatggccggggacacccagtggtccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagaacctattcctggccttgggtgtcctggcccaaaagcccggcccggtgtccaggcacagcagagtcccctggagacggctcttccggaagcctgctgtctgggcagcccgtcgtctcccagcctctgcagcctgctccttctcatcctcctctcctgctgcccaccttcttcgaggagaccttccccgacgcagggctggatcttcaacgtggttccttggttggtggcgattccggccagtctattcagtgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctc

What is claimed:

1. An isolated nucleic acid molecule selected from the group consisting of:
   a) a nucleic acid molecule comprising a nucleotide sequence which is at least 95% identical to the nucleotide sequence of SEQ ID NO:7 or 9, wherein the nucleic acid molecule encodes a polypeptide having organic anion transporter (OAT) activity;
   b) a nucleic acid molecule comprising a fragment of at least 1200 contiguous nucleotides of SEQ ID NO:7 or 9, wherein the fragment encodes a polypeptide having OAT activity;
   c) a nucleic acid molecule which encodes a polypeptide comprising an amino acid sequence which is at least 95% identical to the amino acid sequence of SEQ ID NO:8, wherein the polypeptide has OAT activity; and
   d) a nucleic acid molecule which encodes a fragment of a polypeptide comprising the amino acid sequence of SEQ ID NO:8, wherein the fragment comprises at least 400 contiguous amino acid residues of the amino acid sequence of SEQ ID NO:8 and has OAT activity.

2. An isolated nucleic acid molecule selected from the group consisting of:
   a) a nucleic acid molecule comprising the nucleic acid sequence of SEQ ID NO:7 or SEQ ID NO:9;
   b) a nucleic acid molecule consisting of the nucleic acid sequence of SEQ ID NO: 7 or SEQ ID NO:9;
   c) a nucleic acid molecule which encodes a polypeptide comprising the amino acid sequence of SEQ ID NO:8; and
   d) a nucleic acid molecule which encodes a polypeptide consisting of the amino acid sequence of SEQ ID NO: 8.

3. The nucleic acid molecule of claim 1, further comprising vector nucleic acid sequences.

4. The nucleic acid molecule of claim 2, further comprising vector nucleic acid sequences.

5. The nucleic acid molecule of claim 1, further comprising nucleic acid sequences encoding a heterologous polypeptide.

6. The nucleic acid molecule of claim 2, further comprising nucleic acid sequences encoding a heterologous polypeptide.

7. An isolated host cell which contains the nucleic acid molecule of claim 3.

8. The host cell of claim 7 which is a mammalian host cell.

9. An isolated host cell which contains the nucleic acid molecule of claim 4.

10. The host cell of claim 9 which is a mammalian host cell.

11. A method for producing a polypeptide encoded by a nucleic acid molecule of claim 1, comprising culturing a host cell containing the nucleic acid molecule of claim 1 under conditions in which the polypeptide is expressed, thereby producing the polypeptide.

12. A method for producing a polypeptide encoded by a nucleic acid molecule of claim 2, comprising culturing a host cell containing the nucleic acid molecule of claim 2 under conditions in which the polypeptide is expressed, thereby producing the polypeptide.

* * * * *